United States Patent 10,221,454 (METHODS AND COMPOSITIONS FOR SCREENING AND TREATING DEVELOPMENTAL DISORDERS) - sequence listing, part 9

SEQ ID NO: 111 - DNA, 813778 bp, Homo sapiens
caacatttgcaaaacattcctttattattagaaataaattatttgtataaaaaattgcatgcatcaatcattgcatttatttttagcacaacccagggcttcaatctggtcagccattacaagaaacagactcattgtcttatacaagttaaacaatgtgggacaggaacgggagttctcacaatcacagaaaaatacaagaataacatcagacattatttatttcaacagcattttttttcacgagctaacattagttttccttttgtgatttgttttaactgctcatgaataagcaatactttagcttgacactcattggttttattgtataaaacgggtttcttcactccccgtttattgatacttttggctcatggctaatttttgttccttacaagactgactattgatttgattgattgtagtctacggagatctccaggagtgaatttttgcggtctcatgttcatcatttaagatcatataccacatctcttcagattgtgccatttccctgtttcagattgaatgattgctgtaactgatatatgttgtcttggtagaggaagctgttaagataaatgaggacaaattaaaatagtatataataatacatccttttgttaatatgattttaaaattcaagtcctgtaatgactttttaataatatccagcttttacagcatgttactcattatttttaaaccattcacagtcatgcacagcacaacgacatttgagctcgacagcagactgcattatataaaggtggtcccatgagattataatggagctgaaaaattcctatcacccagtgaacacataacacaacacaacacataacacaacacataattcacatgtttgtggtttgttgtgtaaacaaatttcctgtactaccagtcatgaaaaagcatagcacatacaattatatacagtacatagtacttgataatgataacaaatgactatgttgctggtttaaatatttactacactatactttttatcattattttaaagtagacttcttctacttatacattataaagttaactgtaaaatggcctcaggcaggtcctccaggggtattcccgaataaggcattgctattacaagagatgacagctccatgtgtgttattgccccttaagaccttccagtggaataagatatggagatggaagtgatattgataatcctgaccctgtggaggcctaggctagtgtgtgtgtgtgtgtgtgtgtgtgtgtgtgtcttagtttttaatacaagaagtttaaaaagtaaaatgaataaataaaaatagaaaaaagtctatccttgagtaagggtataaagaaaatattttttatagctggacaatgtgtttgtgttttaagtttttattacaaacaagtcaaaatttaaaaagaataaaaagttcataaagtaaaatttatagtaagctaaaatagtatatattgaaaaaggaaatgtttaaaataaatttagtgtagtctaagtgtagagtttttataatatctacagtggctgggtgcagagactcacgtctgtaatcccagcactttgggaggcctaggcaggtggatcacgaggtcaggagtttgagacaagcttgaccagcatggtgaaatcctgtgtctactaaaaatacaaaaattagccgagcatagtggcacatgcctgtaatcccaattactcaggaggctgaggcaggagaattgcttgaaccgagaggcagaggttccagtgagccgagatcgcgccactgcacaccagcctaggcaacagagcaagactccatctcaaaaaaaaaaaaaaaaaaaaaaaatttacagtactgccatgtcctaggacttcacattcaatcaccactcattcacttaaagatccagggcaacttctagtcctacaagctccattcatagtaagttccctatttacatgtataccattttttatcttgtatactctatttttactgtatctttactatgtttagatatgtttagatatacaaatatcattgcattacaactgtgtacacaattcaggacagtaacatgctgtacaggtttgtagcttagatagactaggctacaccatattgcctgggtgtgtcgtaggctataccatttggtttgtgtaagtacactgtatgatgtttgcgcaaagacaaaattgcctaacaacacatttcttagaacatgtcatcaagcaatccatgactgtagtaaaaattaaatgacagtagaaacaaaaatgctgcagcaattttaatctgtcaaaatcagtagcctcatttatagtatataaatatttactagaaaactaaaaatataaaagtgctaatctttaatattttggtaaaattttacatttgcacatatgtaaaatgaaagaacagatcaattatctgtcctacaaaatataaaaaatattttttactacctaagtcaaagacctcaattcttagaggctgatgtaatgaccaagaaaggtaagtaattataattagctgtcctatgagaatgaatacctcttccacttaaaaatacacaataatcttagactctagaggtaaacatgctaaaatatcaaatatatagaaaacatgtgaattgccaatgcatatttatggtttcttttggtttcatcaaaaggagacaaatgaagataaaatttaagaaaataaagactcaaataaagaaatgtttaattgttctgttgccaacatactgtaaagtaaaactcattattgtaaggccattacagagatattatgccaaatttatactcatgcctaagcttctggagaatataaatctaaatccaaataattcctttgtattgttgaaagatgtgatgcaatgaatctctgtcctaaaattcaaatgtgatgtcctattttttcatgtaattctggaatgaataatcgtaagataaaagatactttaaaaagcaaagaatgtatgtgtttcaatatatgaatccaattcaggatgaaacagatttttagaaaataatttatttattgaacattgaataagactagaaattgtaaagttcctcctcggaaataactgacaatcagactcattccatcttagtgacactattgatggattagacaagttcttaccagagaccaagttcatacaaagttcacaaccactaaaattaactcagatagccctaagaagtgctactatagatgtttttttcattgttgttattttttatttcattgaatattatgagcttcaggctaaaaatagttgacatatctgcttatcttatctacattgcttatccttctaggttattattgtggcaccctgcaaaggaagtagactttagacctggttttaaattacattctattccctgcaaaatgcgtgaaaaaaaaaaaatcattgggccaggttactgggcctcagttttatcactggttcaaaacctacaatactgtgttcctgtaaggtcaaaagcagaatagatcgggatggaacagctgtagtctggaagaaccaatatagaaccagcctccctccctcctttcctccctatctcccttcctttcttccttccttattttcttttctttccatgaaccatacatgagacctaatggagtcttactttctacttaacctttccaaaaggtaaaatatttgttacatttggtttggtgtgaagtgaaacacaatgattttctatgatcactcacttttactttctatttttaatttatataatactctcgtatgcctctaaatttcctctaagaaaataaaatctgtccttcagttctgcttttgaaggactttcatataatcttcacagacaaggtggagaaaaattgtcataagagtgataaaaatgactgttaaaagggtcatccaacttcctacactgttcaatattttcaacaataactaaaatgtatgaaatagttataaaatttgtatatagctagaaaaagaattatggttgaaatagagtagcaagagctgatagatcttgaacaataaagttttcagaagatgtccattcaacagatggcagtttggattagatcagttttaaggatctttctaactttggggctctgtagctaattaaaaattaacatattattttttgaactcttaaacatggtttctagaaagaaaatggtagaattctattgagaattgagaaaacaattcacaaaaggacagcaatgctaattttcctactggttagaaaaggaagtgtaaggttctggaatcagatgatttagtcaacatgaaagcaatgataagggacaaactttgtggatggcagatacctcgcaagaatctttatcccagaagtattatagagcaaaatgaatcagagatgtaccaatgagttcatagggagatgtttttcacggtgctgatgaatatgctcatatgaaaatcagtttttgagcacagcaacagtaaattaatttccttgtgtgcatcacactgtgttcataagctagaaaaaacaaatctacctccagcagcagctgttttcatgaattattcatgaacatagcttaaagaatactatgtacagcatttgttaattgggtacagttggcaaaattcatatatatcaactttgtttctaactcccctcgcactctgttgtgaaataacacttgaccttttttaaaaatgtaaactatagtctgcaaattcagcaactaacacaacactcattggtttcccatccagcttcgtattacttatatttactctgtgtagcttttgaaactttaaaatcttgaacacagatctaccctttcattgtaggatggccatggaagtgaacaaaggttaaaaatggtgatctggagtaggattgtggaaggatgtgtgaagatgtcacacatctttctctcctgaatgagtacactgtaatcactttacttcggcccaacttattcaaacctaaattatactcctgtaaaagatcaatgcactaaaatctccaaagtacaattaaacttttttttcaggcagtaactgatattatcttgatttactttttgactttacttcaccttctaaacgtgagcatctgactcctccagaatattataggcttaccctccaaataggccttgtttttgcaatctttcattcttattttagagaaaatagagaaatacatgcaggctatataatttccatttcaacattaatagaaaataaccaaaggaaaacagtatctgtatgagatttacttcaataatatgagattggttcttatcaatactgagaattttgtttttcagggcatgtatttattcttttaaagtggtgaaaaagtttattaaattttttctccaccactttccaaaggtgagtctgaatgactggtatttatatcactataagtttggttctttaatttggcaaccatattttataaagttttctggattgctgctaaaaaagaaaaaaaaaagagaaaaacaggtaaaacaatagactctggtgagtcatagtgagaagtgccagtgttcaaattacatcactggccaacagcagtttattggcatcctataatagctttcaacttcctacactaatgctgtcaaggtaggaaaaaaggtaaaattctgtcctcaaatcacaagcattctactttgatgcctttaatggcagttacagtataccttttgctaagagccgaaataggtttatcattagtaaattgcttacctatactcagagatgattgtaatgatttgttactaaagcccatccttaccttgcttcgcatatttcttacttcacaaggtttcatgtttgcagaaaggtgaatatgtggagggtgtttgtgaaattcttgtaaggttcatttctctacacgtgactaaatttggtattggtgacccgaagataatctttttagaaccaatctggctaatgattccaggtaagctgatagtaactgaaaccaatatgtctaattaagcaatgctaattaactatcacaggatagttctgtgtatggtaaattagagtagacaatgcttatctagaaatcttgatagaaaagaaggtttgtagatggaatgtagaccataagttgctataataattaaaccaaataaaattaatttttagttttttcttatatttagtgtcaaaagtatggagagtaggggatacagactgctggatgaatatgagaggaagagaatatttttgcataggattttgtccttaatgcctgaccgggtgtggtaactcacacctgcaatcctagcacttttggaggcttaggtgggaggatcacttgagcctaggagttagagaccagcctgggcaacagagtgagaccctgtctctacaaaacaaacaaacaaacaaacaaacaaacaaaattagctgggcatgacagcacatgcctgcagtcctagctatttggaaggctgaggtgggaggatcacttgaacccaggaggtagaggctgcagtgagcctagatcataccactgcactccagtctgggcaacagagcaagctcctgtttcaaacagaaaaaacaaatattgaatccctatgctatattccaaaagactggaagccactctaatacaagtacctttgcttttctttcttttttgattcatctgtagaacctagtaaggtaaaggttgtaatgtttaccatattcagcttcctggtattttaccatacaaatcttcaaattatttgccactctttcatagataccaagatgggcttcaatagatcagttaaattctactggttgagcacagatttctgtgtattgttatcatgtgctttttcctgggtggactgtagagacgaaaataggtaaagaaaagaaaaatggaaaggtggttgtagaaaagattctatttccaggatcatgaggcttttaaagaagaactttaattatcttaatatatccaagaagggaagtcaagggaagccctcaggaagcccaaggaaaggggaccacgtgggagaaacaagtattaactgtgacttaactaaacatattggctaactagagttctcatttccctaaaggcacaaataacatcatttatatgtgtaagatctgtagtgatattctgtaagtatcagcaaactactgatactataaaaagcacccagtatggaacaagaaaaattgtggaattgtttccaagtactaaaagataatttttataagaagatgacgctttcaaataccaagctttgtaatgcttcaaaagaaagatctgaatgtcatgctttgtaaaagagattttgtgagcaagtttgtactctgtagaacagccgctcatcttgagaccatttgcttcgaatggttttaaatgtgatggtgtcacggtatgtgagtaccatcatgcccctggaaacatgtagcacaatccccaagactaggagaagaatgttcaacgtacatctattaggaagtgctcccgctcttgaccatcggaaactctacagatgacttactgttggtttcaagactctcacagagttcacttttcacctcgccatttggtctgtcatttcctttttggatcagtttgctttgcatggtggcagctgtcaccacagccttgaagctcctcttgcgtttttgaacattctgttctggatgaaaaattataatataaaccttgggcatatagagcatgcccagagatactgaagcacttaaactcatggagacagtaagtgttgttgtctggatgtacatctgagggaagaaaaaaaaaagaatcactgttggtaagcctaacagtaggagataaagcaaataacatactattttctaaaattgttccagcttctctgctaaaggcacattaaaaggcacttattgaaattgtccttaattatagtcaaccattcctgtgtcctaacctgcaaatgtaaatgagtaaggttatttttttattgaacccaatttattaaaataaaaatacaaacaaccaagctggtggagtttattttcctttttagattataaataaacatacataaggaaggggaccaaaccagtctggcaaaacactaacacttaatgccacacagaacttctttagaaggtactagtgggccaagtgttattgtagcaataagtttaacccagaaggtaagtatacatagtgaaaatagagtgggagtgcaacattccagaacatcactattacacacctgtgcttgaataatgctagtggttgcatcttcacatcattacataattccaactaccaaaaatcacaagcatgtcataagggcttgattttttttaacagtccctctaaagaacacttccagaaggttctcagtgatagcatcatatcgaaataagtcaggtgcttttataaaatatgtaagatctcctccctccaagatatatgcactgggatatggtcccggtcactgcattctgaaattctccccctgtgctcattgcttgcccttatcccactgaaatcgactgctctgatacttacagagagagctctttctggaaggtttttctttctacaagctagaggttaagaatctgaaaaaaaaaccaaagctaaaatcactgctttggctttttcttttttggttatggtatagaaacagaaacagcagtatttcattctttaaaaacagaaacaaaaacctttgatctggttccacttttcatgtcctgagctcaaaatagaattttccccaaataacttgggatactgaggccacggagaaaccacatcttaagactgtaaagagattctccctttgtcatatctacgaccctcattaatagatctgttcactctatttacatctctgaatatgatcctgattagttggattttttaaatatgttttaatctgttagtcttgctaacatctatcatactagttagatctcatctggcaatcctcaagaccaaactaattgtgtccttttaaataaagaatcaaaaacaaaacaaaacaaaacaaaacaaaaaaaaccattcgccctcaagggtaaataactgaatcagcattagtgttgccttttcctagaggagaaggtttctcttaacagatggcaaaaccttgcggtaaagaactgtccaaaccatgagcaggatgtgaggcacaagttaagaaactgtctttggatataaaatcataccatgcacactgctgaatttactgcccagttcatctgccactaaggctgtccttgcatccttgcataagagctcattgtttaagtgtggaaaatgctttaacgagatttactacaaagtttacaagatttactacaattaagaccatcccaatgaaatagggatgtgtacgtttacggcttataaatctcctaagttttgccatctacttttaagcaacctattattttaaacattcctaagcttcctaagtattggttaatcttttttgaattcctgcttattttcaagctagcattgctgcaaaaacctacatagaaaattgactgcagagagaggacataaaggtaagaaaagaatgtggcaaagtacaaaccacacccatacatgttccaatgccagtcaaatagaaaaccaccagtcagactctttcaagtcaatttagcctaaaaacaaacaaacaaatccaacgacgaaacagccataaaatgatgggaacatctatactgattagttggattttttaaatgtgccttaatctgttagtcttgctaacatgtatagtactagtccaaatagtataaaaatatttttgtaataaacatcctatacattttctctgttaccaaaaatataaataatagtcttctcttatttggaataatttctgcgatatatagtaaatttaatcctgccaaatattagacatgaagaggactttggaatgctagcttcctcgttaaataaattaccgcagtctatccttttggcaagccaactcaatgaaagatgtaataaacacagatattagaattaaatagtaccatggttagtgtagcaagctcttcattggacgctatactttcaaattataccaaaatgctgatcttaattatgtactttcttaagacagcttctgaaaaattttaatgtgagtttaatacaggaaaggcatctaacaaaatccttagcaaactaacagaagaatagaaaaccaaatactgcttgttctcacttataagtgggagctaaatgataagaacacatggagacatagaggggaacaacacacactggggccttttggagggtggagggtgggaggaaggagaggatcaggaaaaataataacaggtactaggcttaatacatgggtgataaaaataatctgtacaacaaacccccatggcacaagtttacctatataacaaacctgcacttgtatccctgaacttaaaataaaagttaaagaaatccacaaaatcataccctaagtccacaaccttacagtggcctagcatttgttacagggccatggaaggaatatgttccagtagacctgggtatgaattctgaaccaccacttaaatacatttttttaaaagataaagtttacagagaaactctagagttattttctgggtgattaaagtccccaaaccaacctcccaggctacaatctaaaccaatcaatcttccctggttattggacaaatatggtatcttattttcttctctgaacagtaagttcttatctatgtcacagggtggggttgggggtaatacttttctcatagaggagttacagggtagcatgatatatttataaaatctcttacagatacaagatagctcaagaaacattctttaccctacaactttgcatctaaaaatatgctaacaaagtatcctcccaggagtataggacaaaagaaggacctattacacacttattcaaaccagttttgtttagagaagagctgatagccaggctctgactatacgatgttgaggaaaaggcctttgtaatctcactttaatgtagacagaataaaattttgtccaaatgtgaactcaagaccatatttactgcctgggccacatgcttagaataatataacagctctttatctcaaagttacagctcatcagaatgcaggaggggactgtattaactcccactaacccacaaaaattcaagagatgctagcaatgatattggatatgtcaataataatcttctctttcccagccttctcttacgtgctccctcctggccctgtcactccaaaatactaacacccagaggatggggactatcttttctatcacacgcactgatggcttgttacttactctgcctccatgccccatggacattttgaacctgaagcagtcagatgccctgaagcagatttaagcaatctctagataagccaggggtgagctgtgacaatggagcatactaatatgaaatcttttctgggacctattacagttccctcttcaaactctggataggtcatttgtacatatcaaggtctactcaacgtaggccatgatgtggtatcattaaagactccaggaagagtgaggagggaggagattttatttttccaggataaaggtcagtcttttgctttcaaccagctgccagtgcacagaccaccacagactctgacatccaacctggtatttttgcaaccccttagtaactaaggtaaactattatgaaacctaacactcaaagcaactttatgccacgtgataagaaacagactcagtatttattcctgactatttctgttttgccctcgatggtttaatcttaccactttgttttagtcaccaggttctgtttggctgctttgcataccgtttgaccagctagaaagctacactaacactgacagcctgtatttctctgcttctgtttctacttcctcatctgcgtgtctgccaaagtgaaacttgcatcaaaaaatgggttttcttttgctttttagcagccaatggacttcaaaataccatttactactagaagtgattttttttttttaaagatgaagaagtttatagagaaactggagttgtcctgtgggtggtaacaccccaaatcaatctatcatgcaaaagtccaaactcataaaattcccctagcaattgaaaattgcaaaaaccagaggcaaccattcagctttgctggctgagcctgaaaccactaccaagctcatatcaaacgtttttattttgttcctgtcttgtttacattaaatatcttcctagtttcattgcttagtctttttctctctgtctcttactcgcttgctgatcatattagaattacacccttaaaccaagacaagcttcatgggtgtgcacttgtacacaagaccctgtaatagaagggccccatgcttggtttaatgctctgccacgaatgttttgaagtctgtaataattgttaaagaaagactcctgcattttcatttcttactgggttccacaaattatatagctagtcctcttttaaaaatcacttatatactgacaaattccgggcttttcttaggaaaggcatttgtcttttgggtcactcccttcggtgcctgacagcatctgaaacttaacaagcctctgattcccaatcttcatccctaaacttgatctcccagtggtctaccctatctcattaataccgtgcttctagttcttgggagagcaggtggacagggaacttgaaattgtcttttactccttttttatactcccaccctatctatgaccatatcctattgattctaccttcaaaatttgctcagaactttcagaatgtctccactggtgttacattgctcagagccatcatcatctctcatttggatcagtactgtaactgtcctagtgttctctttcctgctgcccttgctctcttctgtttgagcatttgattgatcctaacacagaagctagaataatcccattattcataaactgaattaggtcactcctactctccaaagcctactctccaatgacttcccattgattgtatcttgacaatggtccacaagatcctctgagaactcctctggtttactctttttttactcattcccttccacccatactggctccctggctgatcttggaacataccaggcatgcttctacttccagacttttatatctggtggcttgcctcttcactgccttcaagtctttactgaaatgccccagctcagtgagacctttcctgaacacaccattgaaaattgtaacccccaaccttctaccagtattcctagctttatcacactccttagtatctaacacattatatcctaaaagtctatatattttactcatttaatgtatgtggtacctatttcccctagctagaataaaaattccatgaatattgggaattttacctgtgttgttcacggctgtaaactcagcacttagaaaactgtctggattaagaaaatgtggcacatatacactatggaatactatgcagccataaaaaatgatgagttcatgtcctttgtagggacatggatgaagctggaaaccatcattctcagcaaactatcacaaggacaaaaaaccaaacatggtatgttctcactcataggtgggaattgaacaatgagaacacttggacccaggaaggggaacatcacaccccagggcctgttgtggggtggggggaggggggagggatagcattaggagatatacctaatgtaaatgatgagttaatgggtgcagcacaccaatatggcacatgtatacatatgtaactaacctgcatgttgtgcacacgtaccgtaaaacttaaagtataataaaaaaaaaaaaggaaagaaaactgtttggataacagacattctctataatcttttgagttggtgtgagttcatactcccaaatttgggttttaaggaatataactcatgtatttccaagaaggaaaaaaaaaaacagatactgaaactacaaaatatcagaaaactggaggactggaggactccattctttttcatagcaatctctaggctgggagagaaatgtaatcttgggcagataaacataatgcccttttaaacagtaaacttggtaataatgggccattttgctctccatcagcaatgaacagtataattcaaagtcagtcgttttcactttgggaataggagagctctgggatctgccctcaaaacaagttaactgtataactgagggtcaggcactcacattacttctaagttttcatagacttaaatcaaaggatttagtgagacaacatatatacacagtggcacagagcctgggatatattaattaataagggatagctttattgtcattatttaaccttgacaacctgttctctattcatcttccttcattctccacgtcagaaacgcttaacactacttctctctcaaaatcagcttcaagacttttagcctttatagcagaaacacacacacacacacacacacacacacacacacacacacacatacaagcaaaatggtttattcataaggaaatatactttatgtttgtgggaaactttagagtcaccacagcaaagaattatagtccaatttaactctgggaaaaatcaccgtcctgagtgttgtgtttctcctgtcaggtagaaatcacagtgctgctgacccagcagcaggtcagatacattgcactgtgttttcattagtggaggtggagaccagttgtctgtaatccatttgcagtcacttatcacatcccctttcggctcaggacacatatttgcaacatgaagagtcaaatcaaaagctacgaataaagaattgtgaaggaagactacagatgcagagcagggcttgttctccctcctgtgaggtctttctgaacccttaaccttggaatgattgggagaggtggaaactagctaaagagaatgatacagcatcaaccaacaagcagaatatcagcttctctaatgataggaaagaaccacgtaaggaagctcaagatctgttaaagaaggagaaaatctatctgatttacaatgactataattaaacataagtgatctttaatatttggattagtaaataatttgtttttattaaagcctgatggaaaatttaaaaacagagtaaatttttaaaactatggcattattaaataaaatgtggtctttaattttcaattattatatatgagaattatttacagaaatatagtaaataagtaaactgatgttgcattttctactgggatatgtatatgaaaattaatacaaggtgtctactctctcagtgcttattaattcctcctttacaggtatttttgctcatgttttccttcgtggatttctgcttccatggtaacttttggccctttatcactgcagcagcatggacagaactgggaataacagcaatggggatgtctttaattattatcatttgaacggatatcaaaatataataatattttcaggtagagaacaaataaataaaagtataaattagtttagaaagaagcaaggaagaggaaacaattgtttcaggaacaaaatttatctctgaactatattttaaagtatctctatctctatctatctgtctatagttctagaagccaggaaaagagaaaatatgttgaatcctatatttatcactgcctagagacggaagccttgctagaatttaaattttaggctaaataataaattcaggttgtgttatctaaggaaagttggtaaaattatgaaaatggtttcaactgtagttttgcgaaaggcactaaatcttggtcagatagatattttctctataaccctttttaaagacaaaataattgattcagtaactcagtgcaggtgcttttgcggaggcacatgatgttttaaaagtgctatttttttttttctggtgatatcccttaatatagtaagaatcaagaaaaatggtgttatgggctgaattgtgtctcctccaacatttgtatttcgaaggcctaacccccagtacctcagaatgtgactgcatttgaagacggggtctttaaagaggtaattaagttacaatcaggtcattttggtggtccctaatcccatatgcctgatgggcttataaggagaagaaattaggacacaagacacacagaaggaaaatcacgtgataacacagggaaaagatggccatctacaagccataagccatggagagaggcctcagaggaaaataaccttgttgacaccttgatctcagacttctagtatccagcagtatgaggaaattgatttctattgtttaaaccaccctgtgtgtgatacagccctggaaaactaacaggaatggggagttgatatcactgaaaaagttctgaaagttctgtgatagtagttggttgtggttaaatataccaatagaatctcaaagatgtctgatattgattaaaacgatgagtttagatactgtacaataactacaaccataacatctatcaattattgaggatcaagtacagcattatgccaaaacttttatgcacttatttaacccctcacactaatcctgtaaggtaggaatgaataagtctatttttgagaattacacagtcacgaagaagtcatttttgagacacagtcacttttgaaaagtcatacaatacatgaaaataaagtgtagattcaaactgaggtttctctaatttgaaagcccatatccttaccacacaccatctggcccccataaatacaccgagaagtgaaagagcaggattaatgtgacttgagtcctctccaaatcagagaagcatcccttttctaatagatttgggccaaatttcttctaaataatagaggcacagttaaagcacttcaattaatatttagttgtgcattagagggtttctgctgttattaatcagctactttcttcataaataaaagcctcatgtggatcctagaacagctctggctttcttataattacatcttcttaaacttgacaaaataatctagctgagaatatgggcctgaagagctggataagttaatcttttaaatgatgtttagcattgagtttgcactgggttggagcagaaaagtctctgatgaaccactggccaccagaaagaacagggattccctacatgcagaagacattgctgcataggcaccattccacctctatagcaccagagacaggctattgacaatacagcaggcaggcgaaggtggattcaaatacagatgaactgacaaccaagaattagcaaatacttaaggagaatcaagacaccttacaaagagaataatataaacatacaaaaatagatccaatagagctaaagaaggaagactgtggaattaaaattattgttatcttagagaagttttgaaaaaaaaataacaaatccataaaaatatcaaataaattcatataagctaacattttaatcattaaaataaaatctcagtagatgaaggacttctgattctggctatggaggagtagctataatcaaaccaaaccaacttctgagaataactataaaacaatcataaagttaagggaaaaaagactatttggaggtgtcagaggagaaccaaggtagccaggactcaggggaccaagatcctagtaaggaaaaagaaagcacattgacatatgtccagcactctccactgcctcttattcccaggtaacgtactgattctacataggaaagacagaaatctttagacagacctgtcagcagtctcatgggactagggagataaaatctggaatttggggttatcattgcaatcaggacttaaggacccacaattctagggtactacagagaagtaaaccgggtattttataccttttttttcccttgagactttgctgaatcctaagtgtaagaaagcagcaagctaaaaaaaaaaaaaaaaaaaaaaaaaaatcaaacataatctagattcagagagaattcagttagaattcaggtccatggaggagaatgattactcataaaatatcagacatttagccaatatatctaaagggatattgctgaggaggaaaggtaaatcagaaatagacaaatccataaaaacctgaaacttatcctcgaattatcccaatcccagattatatcaaggtgaaatgtcttgatatatatatttcaattgccgactagtagaaaattgaagcttctctagaaggaaataacaatatatataacatctacatttttttaaaatgtacaatgtcagttattcaataaaagattaccagccaggcatgctaggacacaaaaacaaatgaccaaaaaccgtgggcaaacaacaacaaaaactaaacaggtgacagaaatggtgccacagatgatcagaaccaggcttctcagacaaaactttaacataaatgtattgaagaaaatacataatacgatattttcatcagaggactggaatgtgtctgtgtgtgtgcctgtgtgtgtgtgtattgaagtcaaaaattataggagtgaaaaatataataattgaattgaatagatgagtttaataactaattagctacatggcaggaaatgactgatgcattaaagataaatcagtaaaaaaaatatccacggtgaaggatggagactataaatatttttaaaattcagaaagaaattattggagatatataaaacatgatacaaaatttgaataaacatgaatcttaagtcctagaaagaaaggagagatataatagataaaaagaaacacttaaaagagacactggacaataattttccaaaacttatgaaaaataatctattaaattgtacagaaaaaaattaccagatggccacattctgggaaatcctaaaaaatttcaaggatttaaatacagggtatgctatctgactaatgtgaaatcagattagaaaatagaactaggttggaaataaataacaaaagaaaattgccaactgtttgaaaattaaacaatacatttctaaatcactcataagtcaaaagaaaaacaatggaaattagcaaatattttgaactgaataataagatacaacatatcaaaagtcatgggctaaagcagacacaaaagaagaaatcttgatatgattattcatctcaaaaaactaaagaaaagggagagaaaattaaatccaatcaatatagaaggaaggaaataataaagataaaagtcaataaaatagaacacaaatgtaacataaagaaaatcaacaaagctaaaaaaaaaaatctttggaaagactgtaaaattaaaccactcacaaggttgaccaagaaaacaagaaacaagacataaattaccaataatttggtaattattcctaaaaagggaagaagatgtgatataagattttaaaaatatgccagcaaattacttctaaatgttgttagccaaaaaaaaaaataaagtgtatgtttaaagtttaagagcaacttagaaaaaaatgaaaatagtatctaaaactcctgaactatcaaatgaaaaaaaatgagagaaaacttgatcagttaaaataatttcagagaagacaaaaaaagaaacatgagaacatagtaaaaagaaaacagaaaacattagcaaacataaatcattaattttcattataaacactaaattccctatttaaatacagatattatcaggtttgattttaaattgtattctcaaaagagaaaagcatatataaagattataataagccaagttgaaaatacattttctatgccaggaaaatgtaaacaaagaaatctggaaagtaatattaatataggacaaaatagaatgcaagatataatcattaaattatgcaaagaatatatatacacacatacaattaatccattatcacaatgtatgtaagcaacgcattatagaaatgcaaggatagacaaatccataaccatcatgagagattttaattcatcttttcaaagatagaaatttgattatacaatatataattaagaatagtttgaataagtcagtaataaaattatcattttcactgcattattttaaaacataaatgagcttcacagagatcaattatgaattaggttatccagcaacaaaaataaaattttcataacaggaaacatgagactatatcctttcacctaaaaaggtaatcaaattaaaattataatttataaataaatatgagtttttatttggaaaccaaatatcatccctgtaagtaactcctataaaaaggaaagtacaaactatttagaaattgaataatcatgaaaacagtatgtatgaaaacttgtggatacaacctaagtggtgcttgaaggaaaatttaaagtccaaaatggcaatcttaggatgcaggaaatctcaaaaattaatcatggaactaggtaaactttaatagaaaaaaaaaaagtaaactcaacagagaaagaagaaagtatttgatataaaagaagaaagcgataagacagaaaactatagtactcataaaccatatcatatttggtaatatgataagtccacatagaaatgaaaaataagatgtaagtaccagtacaaattagtttttttaattctaaaagcaaattttgcataactttacaccaataaatatatacatctagaaaaaatgcaagattgcccaggaaatagatattagaagtgagaaaacaaaacaaaactatatggaactaaaactatggtgagtaaatcagaaaggtagtacgtgactgacagaatgatgatgaccctgcctgagagagagccagccatggagtgagaacaaggaaaacaaggaaagtattcacccccagctcctatgctgttcccctacctctcatcctctgacacttacatcagcatttttattttgcttttcattgtgtattaggtagggtacagtccttttcagaattagtgatgcaagtgcatggcaaatatagtggcagagacaatttttctgatgtttaatctcctcttctaatattttatagtgtcttgctgctatttgaaaggaagaaaataatggtgggtatcttttcccaacgtgctgaaaaaactaattacggtggcaatgcagaggctccactcaccccttatccctgggctatctctggggagcctggatatttgctaagattggcccctttactaaggacagccctatgataaggagagttgaggaagatgtaaagggaactctatctgaaagggtggaaagcataagacaactaaccacttccaactcagcctcaaagactcagaaccctttctgtgttccacaccttgataaatggtatctttcacaactcaaggatcatgacctgccatgattcagcaatatttttacctgctctttttatgtctgcctagatcctgacagccctagacttactacatctctgagacaatatatagggagatgttcctgggtataagaaaatcttagtgctaggactggagcctccagaagattcccatgaaggtcaaagtagccaggtttcaagagaggaaaattctcagacatgacatttagaactttctataattggtcactatcatgtctgatgtagatatatgggtctgcttggatactagctatggctgaagcactccagaaaattaaaactttatccatacatatggtgacctctccaagtcactatacctagccaagatgaagcatgcactaatatgagaccagtaatctgctacagtgtgtactgattacacaaattggcactaagagccccatgttgaagattcaattatttgtggtaatgacagctttcaggaaaagacaaaatcatttcaaataggtcaaaaccttaaaacacccagtaatcacaacctcagaaactgtaggtctcaaataactaccagtgaaaggtggagaaggctttgaccagtactcataactctagaccacagacaaaaagtcctcttcttgcacattattccataagctctgtgatgtaaaagagagcttagttgttgcacaatcttatctacggctgaaaatcctcaccagctttagcagaggcattactctgaataaagcacctacagggctttaagattattaccgtgaccaggtacctgaaagagctaaatacaagagagtgaaggagaaaagccttatgtacaattttcaatgagaaactagcccgaagtccctcccacaacagtttgagacagcttctaggaccatttcatgacagtcattaccttgctggtagccctgcaactgacataagttctcagaacaagagagttgtgaagtatgagccagaaccaagaaacttgtaagtatattttagagccattagtcactcagaagccctaggcatctaaatctcctaggacagtgaactcagacatcatctgaaatatccctctttttgatgagcatagtgccttatgctactagtttcattaacttcattgatgtcctgggttcagatgacctattttgcccccacccagatcaactggacaaccttcttaggtcctgaatagtccttaggtcattagcagtctgactgagtcttctcttactgaagccctgtgttctgttgagaataaggacagcagattactcctctaatcaccagtctgctcccaaagtgatgcagctcagacacaatattccactgaaccaactagaatactctgaattttattgaaaatcactcaattctttatacatctctcacctgtaaatccattttagtgtgctttgtactcctaacccacaaccacaactcctctctatccccagcctcttctccctgcctctgcccttgtggtcttaactgaaactgctctttccaagagagttgtttccaccccagactttcaagtcatggttgtctttatttcttcaattcatattcctcagggaagatgataaggttggaccatcctttattcacctttgctgcttccaggtcattacagacttgtctttttctccaatatcctgcctttgaaactgtcttaacattcaactctacatcctctttctttcatccttgttcccgtatctgccatcagttgccttcattcattggaggttctggctctggtacctaggcttgctctcaatcccaaatgatgctgttatttcggatgaattctacatctcattctcatgatcacagctagaatcttcaatactgtgtttagtttcttgtaatacattctgtaaaatacttttggcttaatgtattgtttttagtaagagattgtttacattgcattgcattttcctttaagttatttcatttttcccttagaataaatataaagagttatgtcacatgcttcagtgatgtgagcattgttgtcgaggagtgacaagtaactaaaaatatgtagaagggatggatatttctcacttctcataatgcatgtttccttatggaagtggcttgccaggcagcctttcaaggtaccaaaattaatataaatgtgtacaggaatcttttgcaataaaactagttatgacttgttccaagtatattttaaaactgaggctgttaagttttaccacactttactgtgacagaatgtgaacttttccaagtgtgaaaatataggtattaaatagggtaacttgtattttcctcagtaataaaaaagcacatctagctattatcagacaaggtatgtgcagttataatagctgttttatatattatggtgttaaaaattttaattaaatattttatattcaaaatgaatctttatttctaggatttttatggtaattacccacatcacaataacaatatttactacagttttcattgcaaaggtcctgtatttcagttagacaattagttagatagacgtttgtggatggcataaagacaattatcacatgtaatattatatgtataaaattatatctcaaatgccaccagtcaatttaccagcataattttggaacataaaacatttttaagttggaaggccatctggatgctattattaaaactatgttcctaagagtaggagtaaagaattatgtggataaattattccattagtaaatctgataggctgagttccaaatatgtacaaactactgatgcttcagttttcagaataattgcactcaagtgaaaacttttattgtcgtggaggaaatattgagtattctttcttttgatgtgatacaaaaaatggtcctatactttctttttccttttattatttttaccaagcaactttataaatgtagcattttaccaagatgacactcaggagaaaaagacagacatttgtaatagggaaaagggatgtggcataggtagctaacaggacaccaaaatgtgtactccttcttccattgtattggattgtttctggggagtgcctggccagtcatcgactgttctgactagatgtagtgtggttatttgactggttttcaacctatataatgtgaacaagatgataaatgtcataaaagtgttttacagaattaatgtgtgtgcacttttccctagaaactcttacctcctgttgctgattctattatttatgatgaagagacatcaggggatgcaaagctataggatggaagacataggggttcctgaatcactccatggaagaaaattgccattcaaccaggaactacctcagactactatgtgagtgggaaataaaattgtatactcagtgcatatactttgaattattttcctacaagtggtggatacgtatcgtataactggttagtcagcccctctgactaaggaacaagtgaaaactgagaaggatgacagatgatttccatggctatggcagaaaaatgaaattacagtatcctcagatggattgtaacgattgaccttgtgcacattaatacgatgttctaacaaagtgtctagtctatcaaatataatcccaagccattaaatttattcctaggttcagtgacctcggtctttggttagggaaagaaagcaccaagctaggctttttattaaattttcaaggaagaatcatttcaggtacttcatatagccttcagtaccagagggagtttataggaaaggaagtctatataacagcatttccaaaaggaagttgggctgtcaagttaatagcctaaaattcctatgtcagcagctttgcacttgtgcctgatgtacaactttctcttttgacctctttccctcagctagttcaaatctgacactgcctgtaaccaacttctttgtctctggaaacaactattgccaatctctgaatatctaagaaaaaaaataactacaaatttgtcttcatttaaatatagtgtttatatatatacatttttatttttgccattatgctgtgtttctactacataaaatatagttacagttttaaattgcagttttctatgattaaagaagctgaattgcttttcctataattattgagcatttgagtatcttcttctgaaagtgatcaaattttttgcccattttctattgagtcatttatcttttttcttatcaactttagctcctccattacatattatggatacaagtttcttgtatgtataatgcaaatatcttccacttcttttactgtgtggcttgccatctttttatagtttttgtcttgaaatctattttgtctgataaacgtatagctacccttgttcctttttggttccaatttgcatggaatgtattttaccattcctttattttcagtctatgcatctttatggtgaagtgtgtttcttgtgggcaacagatcattgggtcttgtagttttttattattttttatgatttttgaatcgattctgtcactctgtcttttgattgaagattttagcctatttacattcaatgttactttattgataagtaaggacttactcttgccattttgttatttgttttctgattgttttgtggtcttctcttccttccttcctgacttcctttcagtggaggtgatttttctctgttggtatgttttaattttttgctaatttttcattgtttatctgttgtatgctttttgatttgaggttgccacgaggcttgcaaatatcatcttatttttttagactgatgacagctattattttaaactcatgacaatgtaatgcttattacataaacaaactaataagcaaagagaaaactattaaaaactctaaactttaacttcatccccccacttttgaggtttttgttgtttccatgtatatcttagtgtattgtctatgtcttgaaaagttgttgtagttgttatttttaatcttcatttcttagtctttttactcaagatgggtagtttacacatgacaattacagtattataatagtctgtgtttttctgtgtacttaataataccggtaagttttgcactttcagattattttttccttactctcctagcatattttttttgataatcaaattctctcagctacatatgttgaaaaagaatttccacaaccctccattgtgaccattatcatgaatcagatgaacatatatgacggggtctgtttctcaattctattccattccattgggctatttttccatccttgtatcaatacctgctgctttgttactgcataatttgatagcaaacctcaatacttggtagtatatgtcttccaacttaatttttttctccagactgtcttcgctcttcttggtcctgtataattccataaaaattttagagtcagcttgccagttttcgatacacacacacacacacacacacacacatccctactgggattttgattaggattgcattaatgtatagctcaatctcggtatttgatatctttataaaattgaatcttctgatccatgaatttttatatacttccatttacttaagtcctctttaattcgtttctctactattttgtagttttcgatgtagaggtcatttattttgttagatatatttttagttatttgatatttatgctgttgtaaattttatatttttatttttatgtattcattccttctatatagaaatgtaattttgtatattgatcttatattcagtgaacttcttaaacttattgattctaatagtttatctgtaatttcttttggaatatctttacacagaatttatgtcatctgcaaatattgaatcttaccttttctttctaaactttatgtcttttttctttttattgtcttgcactagataggaatatcagtacaatattgaataacagaaattattttcagtatgaaaaacaactaggcatctttgcttttttcccaaatccaggaagaaaacttttagcaattcactgttaagtgtatctgctgcattttataaagcacttattaccagattagataaattctcttatatgcttagtttgctaataatgcattttaagttataaatggatattaatttaagtgaagtttagttaatttaagaaaaatttgcctttttatactttttcagtcttcctgtcaataagtgtgtcttttattaaaatcttgttctcagtctttcagtggaatcctgtaattttcttaaaaaaggtactttttttttagttagaattgttctaaagaatgtaatggttccattataaagagggtattttttaacccatcacactttctaacaggttattaataggatataagagagatgttgatttttttcatttaaaatgcatctggtcattgtattccttattaatgtaagaagcatttacttgatgtctgttgatattctaggaatatgatagttgaaaaaagaaagattatttttcctcttccttttgaagaagtagaattcttgattctgtataatgtccatattagtcagggttctccaaataccaatttcctattgatatatgtatatattatggaaattggctcacacaattatagaggctgagaatttccatgatctgccacctgcaggctggggaatcagaaaagccaggggcataattcaaagtccaaagacctgagtaccaggggagccaatgatataagttctggtccgattccaaaggcctgatgtcccagagcagaaaaaaatcagacgccccagctcaagaagagagacggaattttcccttcctgtacctttttgttctattcaggccatcaatggattggatgatgcccacccacactggtggaggggtggtcttctttactcagtctacctattcaaatgctaatctcttctggaaacaaactcataaagatacccagaaataatgcttcattggctataaggcatccctttgcccagttaagttgacacaaaaaacttaatcctcaggacatactgcattggttttgaatttctgggtaaattctaaataaaattaaggaataaacattcttttattattattattatactttaagtttgggtatacatgtgcagaacatgcaggtttgttacacaggtatacacctgccatggtggtttgctgcacccatcaacccatcatctacattaagtatttcccctaatgctatccctctcctagccccccaccccccgacaggcttcagtgtgtgatgttcccctccctgtgcccatatgttctctttgttcaactcccacttatgagtgagaacatgcggtgtttggttttctgttcctgtgttagtttatttcgttgctgagtcttcaagaatgcctctagaatcttatcattatgaatggctttaattctttaagacaaattttcttcattagcaaatgagagcatttttctattactagttttcacagcaatttcttttcttttaaaaaagaacagatatcgaaggcttcatgcttttttcatattccatttatagtatcttaaggcttttatgattagacaaaataactagatttccttgtatatttaatatattctcattgtgacagtattttaattctattgaattgttgcttccactattttatttactcttttacatctgtatttataagtatagttagtctagttccttttaaacaaagtgtatactcttaataatgcattactacaataactaacatgttatgaattactatgtgtgcttaaaacaaaatacttagtgtttatctcagcaaagggcagaaaaaattaaaatgtattctgaaaacaaaatcaaatatgtttaagaattttttaaaattccattgcatacaaatattcaggcaaaggcaggggctttataaacatgtcaaagaatgaggtcaatatatttggttgtgatactcaataaacttccatttaccattctcagaacatatccatgtggaaattggtctcatggaaaaattttttaaatcattttccagccatagatatagtggcaaatgatttaatataatcaaacttcaatttcctcatctataaaccttttataacgatatcatctctaattgtctcactagataactataaaaataaataagataatgcatatgaaattgcctcataaaccatgaagcccataaagcactgtaggacactttgaatatctggtgttgaccataaaatttcaatatctgcccttattgcttgcctacaatcccagagagacaactggtgcaaaaagaattgaaatgctgaataacaagaaaaagacagtgtaccattgacataatatttgaaggttttgtatccagctaaatctctgtctctctcccctactattctttttgatatcaacatgtacattgatagtccacccaattccttggcctttcaatccttttcatttctcacttgcaataatcattttctctcatttgtcttaagaataattgcacacttgccaatgtcttaacttcaaacatcctgagctctgaccactaccctactttttcaagcctatttcttctcttacccacatcaacaattcttcaatcctacaatttcctgtgatactccaggatataagccctctcatattcatctattccttcattatctgtcttgcatttcattgccattaaaagcattgctttgaaaaattcttcacttctttgttcctttctcctgccattgtctgtgtccaaaaaagaaagttccaacctgctaaaatctaactcactgatacttctattgcaaaagtgctaaaagctaccagaatgctgaaagttagcttattgtcaattagactcattttaaatggttaacgataagcctcaagtgaatctcaggcagcatgctatactattagattgtcctcttcaatcctacctttcaagaacatgactaattcatgtatctttcctaaaaactgcaataccccctcttctcttaacttttatttgataaaatagttcttatctcacaaagaaaatagaaaagacaattggagaacttcacaaacttctatacaacttccaacaatctactgactcctttaatctttgtttcagcatttattgttgttagtatataagaccaacacccacttgtgcataagttcccatctccttcacctaataaaggacacacttggaacttgttttcctcacatacctacattttcaattttaccagagaataatccagtagatggctatcacattctatcttatgaaaagtcttctgagattctctaacaaatattttaaaaatcaactttcaccattctacagtaaaattcagtgaaactattatctgtatttgctgaatccacttgccttcctttcattcttttctgaacctactccaattaggctttcccctcactcttttatgaaaactgcttttgtcaagttaacccccatgttgtcaaatcaaaatgaccatttctccatctgatatggtttggctatgtccccacccaaatatcattttgaactgtagctcccacaatccccacatctcatgggagggactcagtgggagggaattgaatcatgagggtggttacctccaggccattcttgtgatagtgagttctcatgagacctgatggtttaataaggggcttcccctcactcctttgctctgcacttcttcgtcctactgccatgtgaagaaggatgtgtttatttctccttctgccatgattctaagtttcccgaggccctcccagccatactgaactgtgtgtcaattaaacctcttccatttataaattacctagtctcgagtatgtcttcattagcagtgtaagaaaggactaatacagtaaattggtactggtagagtgtggtactgctaataagataccagaaaatgtggaaacaactgtggaactgtggaactgggaacaggcagaggttggaagagtttggaagtctcggaagaagacaggacgatgtgggaaactttggagcttcctagagactttttgaatggttttgaccaaaatgctgacagtaatatcaacaatgaatccaggctgaggtagtctcagatggaaataagaaacttattatgaactggagcaaaggtgattcttgccacactctagtaaatagactggtggcattttgcccctgccttagagatctgtggaacttttgaccttgagagagatgatttatctggcagaagaatttcttttttttattttattttattattattatactttaagttttagggtacatgtgcacaatgtgcaggttagttacatacgtatacatgtgccatgctggggtgctgcacccattaactcatcatttagcattaggtatatctcccaatgctatccctcccccctccccccaccccacaacagtccccagagtgtgaggttccccttcctgtgtccatgtgttctcattgttcaattcctacctatgagtgaaaacatgcagtgtttggttttttgtccttgcgacagtttactgagaatgatgatttccaatttcatccatttccctacaaaggacatgaactcatcattttttatggctgcatggtattccatggtgtatatatgccacattttcttaatccagtctatcattgttggacatctgagttgcttccaagtctttgctattgtgaacagtgctgcaataaacacacgtgtgcatgtgtctttatagcaacatgatttatagtcctttgggtatatacccagtaatgggattactaggtcaaatggcatttctagttctagatccctgaggaatggccacactgatttccacaatggttgaactagtttacagtcccaccaacagtgtaaaagtgttcctatttctccacatcctctccagcacctgctgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgctcatgtccttcgcccactttttgatggggttgtttgttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggctttggttgccattgcttttagtgttttagacatgaagtccttgcccatgcctatgtcctgaatggtaatgcctaggttttcttctagggtttttatggttttaggtctaacgtttaagtctttaatccatcttgaattaatttgtgtataaggtgtaaggaagggatccagtttcagctttctatgtatggctagccagttttcccagcaccatttattaaatagggaatcctttccccattgcttgtttttctcaggtttgtcaaagatcagatagttgtagatatgcggcgttatttctgagggctctgttctcttccattgatctatatctctgttttggtaccagtaccatgcttctttggttactgtagccttgtagtatagtttgaagtcaggtagtgtgatgcctccagctttgttcttttggcttaggattgacttggcgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgaacagtggtttgtagttctccttgaagaggtccttcacgtcccttgtgagttggattcctaggtattttattctctttgaagcaattgtgaatgggagttcactcatgatttggctctctgtctgttattggtgtataagaatgcttgtgatttttgcacattgattttgtatcctgagactttgctgaagttgcttatcagcttaaggagattttgggctgagacaatggggttttctagatatacaatcatgtcatctgcaagcagggacaatttgacttcctcttttcctaattgaatacactgtatttccttctcctgcctaattgctctggccagaacttccaacactatgttgaataggagtggtgagagagggcatccctgtcttgtccagttttcaaagggaatgcttccagtttttgcccattcagtatgatattggctgtgggtttgtcatagatagctcttattattttgaaatacctcccatcaatacctaatttattgagagttattagcatgaagggttgttgaattttgtcaaaggccttttctgcatctaagaaatttctaagcagcaaggcattcaagatgtgacttgggtgcccttaaaagcattcagtttcattcattcacaaagatatggtttggaattgaaacttatacttaaaatggaagcagagcataaaagtttgaaaaatttgcagctgacaatgcaatagaaagtgaaaacccattttctgaggagaaattcaagccagctgcagaagtttgcgtgagtaatgagaagccaaatgttcactgccacgacaatggggaaaatgtctcccgagcatgtcagaggtctttatggcacctcctcccatcacaggcctggaggcctgggtggaaaaatggtttcctgggcagagcccagggccctactgcttcgtgcagtctcgggacttggtgccctgagtcccagccatggctaatagggtccaatgtacagctcaggccattgcttcagagggtacaagccacaagctttggcagtttataaatggtgttcagcctgtgggtgcataaaagtcaagaattgtgatttggtaacctctgcctagatttcagaggatgtttggaaatgtctgatgtccaggcagaggtgtgctgcagggatggagccctcctagagaacctctgctaaggcagtatggaaggaaaatgtgggatgagagcctccacacagagtccccactggggcactgcctagtggagctgtgagaagagggccactgtcctccagaccccagaatggtagatccacctagagcttgcaccttgtatttggaaaagctgcagacactcaatgccagcccatgaaagcagccggaactggggtggtattctgcaaagccatagggacaaaactacccaagaccatgggaacccacctcttgcatcagcatgacctggatgtgaaacatgtagtcaaaggagatcattttggagctttaagatttgacagtcctactggatttcaaacttgcatggggcctctagccccttcattttggcgaatttctcccatttggaacaggtgtatttacccaatgccggtacccaatgtatctaggaagtaactaacttgcttttgattatgtaggcttataggcacaagggatttgccttgtctcacatgagactttggaccgtggacttttgaattaatgctgaaatgagttaagacattagtggactgttgggaaggcatagttagttttgaaatatgaggatatgagatttgtgaggggccagcttggaataatatgcttaggctttgtgtccccacccaaatcttatcttgaattatagctcccacagtccccatgtgtcttgggagggacccatttggaggtaatttaatcatgggggcaggtttttcccatctgttctcatggtagtgaatatgtctcatgagatctgatggttttataaaggacagttaccctgaacacactctcttgcctgtcacaaggtaagatgtgcctttgctcctccttcaccttccaccatgattgtgatgcctcccaagccatgtggaactatgaatccattaaacctgtttttctttataaattacccagtctcagatatttcttcatagcactatgaaaatggactaatgtatcatttttatattcgttttatattcattgttctctcagcaatatctcatacatttaattatctcagtttcagttgatgtcctaaaacaatttggaatgatttattttccacattccaaaatgaagtgctagatttccaactaaaaagtatttgcaaaggaggtatttgaaatacacacacacgtacacacattcatatatgtttgtgcatgtgtgtgtgtgtgtgtgtatatatatatatatttggagacagggtctcactctgtcacccagcctagagtgcagtggcaggatcttggctcactgcaacctctacctcccacgcttaagcaatcctctcacctcagcctcctgagtagctgggactacaagcataggccaccatgcctgcctaattgtttaattttttgtagagatgaggtttcaccatgttgcccaggctggtcttgaattcttgggctcaaataatctgcctgggatcccaaagagctgggattatgggcaagagccaccatgcccaacctacatgcatttttaatccttagctgaaaacctatgttcatcctgaaaagactttaaagagtcctagagataggccgtgagttgaatagggaattttcttgaaggaagctactgtgctgctatagctttttccttcctaggcttgcaggggagggttttcctgcctcatataagactggtatgtaagaaataacagcacatgaaatgtatcattcattcagcaaaatcaagtgggttttatccctgggatgtaaagatggtttcatgtacacaaatcaattaatgtgatacaccacacttatagaacaaaggataaaaattatatgatcacctcaatagatgcagaaaagacatttgacaaaattcaacatcctttcatgataaaaataattctcaacaaattaggtggaaagatcctcaacataacaaatgccatatataacaaaatcacagctaatgtcatacttcacagtgaaaagctgatagcttttcctctaagatgaggaacaagacaagggtgcctacttttgccatttctattcaacatagtattgggagttgtaaccaaagcaattatgcaagaataaaaagataaacgtcatcctaatcagaatgaaagaagtgaaatgactaatgtttacaaatgacatgattttacatacaggaaaatctaaaaactatgaaaaaaactgttagcataaacaaattcagtatagttgtaggatacaaaatcaatatataaaaatcggttgaatttctatacactaaataacaaactatccaattaagaaaaaaattctatgtgccatcacattaaaaaaataaaatacatagacaaaagtttaaggaggtggaagatctgtgtactgacaaccataagacattgatgaaaaaattgaagaaagacacaaaaaagttgaaagagagtccatgttcatgaattggaataattaatattgttaaaattctcatactatccaacatgatctacaaattcaatgtaatgcctatgaaaattaaaatgacttttaaaaaatagaaataggaaaaaataatcctaaaattgtacggaaccacagttaactccaaatagacaaagtaatcttgagaaagaagaacaaagttgaagacatcagactgcctgattagaaactacattacaaagctatagtaatcaaaacagcatggtgcaaataaaaacagacttatagaccaatggaacacaataaagagcttagaaataaagctacacatatgcagtcacctaatcttttacaagggttccaaaaatatgcaatggggaaaacatcatccaacaaatggtggtgggaaaactggatattcacatgaaaaataatgaaattgaagttttatcttatatcatacataaaaaataactcaaagtgaatgcattaaatgtatgacctgaaaccttaaaactctttgcataaaacacagggaaaagctcctttatgttggtcttggcaaagtttttttatacaacaccaaaaacaccagcaacaaaaataaaaataaacaaacgggactacatcaaattaaaaagcttctgcatcctgtaatcccagcaactcaggaggctgaggtgggaggacagcttaaggacaggagtctgagacaaaccaagttatgttgttttgaggctgggcaacatagcaatactcatctctaaaaatatgaaaataaaaagattagccaggcatagtggcatatgcctgtagttccagctaagaggctgaggtaggcgggttacttgagcccaggggttcgaggctatgcagtgagctatgattgtgccactgcactctagcctgggtaacagaaagagccatctctaaaaagtgcttctgtgcaggaaaggaaacagcaaataaaaatacaagttgtgaaaatagagaaagtatttgcaaaccatacatctaataatggattatgtccaaaatatgtaagaaagtcatataactcaatagcaaaagaaacccctgattttaaaatgggcaaaggacctgaatagacattttttcaaagaggatatacaaatgaccaataggtgtatgaaaagacactcaacaataataatcaccaaggaaatgcaaatcaaaacaacaatgacacattacctcacaactgttagattggctattatccaaaagaaaaaaataagaaatgttgacaaggatggggagaaaaggaaaacattgcacactgttcatagggatgtaaattgttatagccattatgaaaaacattatgaagattcctcaaaaaaataaaaaaaaaactgccatacaatctagcactttgggtatatatctaaaatgaatgaaatcagtatctcaaggagatatctgcacttccatattcattgcagcattattcacaatagcagagatatggaaataacctaagtatctgtcagcaggaaatgaattttaaaagtgagatatattcaattctttaatagattattattcagccttaaaaagaaaagaaattctaacatatggtacaacatggatgaacttggagaacattacgctaagtgaagtaaggcagacatagaaaaacaaatattgcattatcccacttatatgtggaatctaaaaaagttgaacttatagaagcagagactgaaatcttgcttgccaggagctggtgggtgggggaaatggggtaatgttggtcaaagcatacaaagtttcagttatataataaataagttctggagatttaatgtggcagcatggtgactgttttgtatactaaaaatttgttaagagagtagatcttaagtgttctcacctgacacacagacacaaagataactatgtgaggtgatgaatatgttaattatctttattgtggtaattatttccacagtgtatacatgtatgaaatcatcatgtcagatatcttcaatatatatactttttatttgtcaattatgtctcaataaagagactgagaaaaggagaagtaagagaaagaaagaaagaaagagagaaagaaagaaagaaagaaagaaagaaagaaagaaagaaagaaagaaagaaagaaaaaacgaaagagaaagaaagaaaagaggaaggaaagaagggaggaagggagggagtgatgaagggagggagaaaggaaggaaagaaggaaaggagggaaaaaaggaaagaaattttaaaaacttttctaccaagacaatttatttagagtattgtgttactttcctgtggctgttctaacaaattcacacaaactgggtggatagaagaaacaacagaagcttcttttgtttgttttcaagtctggagaccaaaagttcaaaatcaaggtgttggccatgcagttctctttccctcttctagcttctgatggctccaagcattccttggttggtggctgcataacttcaatctctgcttccatgtccacatggccttctcttctactctaaggacacctgtcattggattcaagtcccatttggctaattcaggatgatcacagagcaaaatcattaactttagatctgctaaggccccttttccatataagatcacatttacaagttccagaggttaggaagtaggactatctttttaggagacaccatttaacacacaacaattattaatctcatcccttgctttatcctttcttgcctaaattaattttcttttctttgttctgaatgccacatttactttttactttaatattctgattttaagtatgtatgcatattgtcttaaatccatcttgagcaaggtaaaacataaatatgagattattctttaaatatccaaagctggatcagagacattactggcgtgagataaggaaatcaacgatcacttctctggtcagtttccatttttttcctgtttatctatgattatttttctcataattagaataattaatacctaacagtaaataatctatttaattttcatggtttttgtatattacttagactcaaaattcagaataaaagcaatattttgcatactgtttattacattaaaaaatgatttctcttagaagctataaaattgtcttcaaagtagccaaatgatatgagcatgctaattgagaaatctagttatcattctcaaaattcatgctggtaatcactagaaagtatcagggctttgggataagttagacctagatttgaaaactaggtcgaacactaaatggctgtgctaatttttagtaagcttcttgccctctctactattggggttcctagttttcaccttatgaactaacaccaaaatatatttatgataaagaatatgaagaatcaatactgccctagatcaaagcagaaatgtatgatataatagccatttttataattaaatatgggtaaatctgttttcaaaagaggggtaggtggtaatgggctagatattttcacatatttctcagaagatgatctttagtctctacatcaatcatgatattaactttcttttgcttgaaattttgacaagcctcaactaccttagccttttatgctaaaaatctacactagtaaatatatgataatattctgttcttcacaagcaaatgaaatgatcctaatcttgtgttggtaaactgaattacttttaatgtaatggaagagagttgtgcattaagacatttttaaataaaattattgatacagaattcatgtatccacttaaagtacacaattcagaagtttttagtatattcacagagctttgcaaccataaatgtaatctaattttagaatattttattctccctgtacccattagcaatactctccatgagccttcccctagccctaggtaatcactaacctactatatgtctctgtgtatctgcctaaatctggacattttataaaaatagcctcatactatatgcaatcttgtgattgccttctttcatgtagcataatgttttcaaggtttatccatttcatagcatgtatcagtacttaatttcttttggttgccaaataatatttcatcatatagataaaccaccttgtgtttatccaccagtcagctgatgtttatttgggttgtttccagtttttgactattttaaataatggtactatgaacattaatgtacggatttttatgtggactttcaaactttatcgtggagatgacagagagatagacagacagacagacagacagacagacagatagatagatagaaccactgtgttatatagaaactatacttaacattttgaggaactgccaaattgtcttccaaagtagctctatcatattataatctcagcaatatacaaggttccaatttctccacacttttaaacacttgttgtctatctattttcatttatgacatgacccagagggaaaaaaatcaaccagaatgtgatggcaacccaaggtggaatgcagactgtgacgaatcaatctaaccgtattacaaataaattatataactagactgaagtgggtgaagaagaaaggaaatgacctgagtaactgaacaatggtgttttgggccaggctcagtggtgcacacctgtaattccagcactttgggaggcagaggcagacagatcacatgaggccatgagtttgagacctgcctggccaacatggtgaaactctctctctactaaaaatacagaaattagccgggtgtgggggcgcacgcctgtagtcccagctacctgggaggtgaagcacaagaattgtgctaacctgagaggcagaggttgaggtgaactgaaattgtgccactgcactccagtctggttgacagagtgagattctgtctcaataaataaataaataaataagtaagtaaataaaatggtgttttgactagctactgtaaggttaaagacaaaatcagttgtacacaaaaactataattggtaaatttgtttctcacagagctatgggttagatttgtaagctactgtatacatataccagggcttaacaaataaagatatatattgtatataaagggagccaaatttctcactgtgtgagaaagaaggtacaatcaagaaaacaggaaaagttagaatgacccttgtaatgttggttcaaagtcagaggtatcagtaaaacgcaagggctttcaacatatatttatgtgtacgtgtgtatatatataaaaatagatgcaaaaataaataaataggtgactgtgcccatggtttagtgcatatacatgttttctagctttgagagagcctagagacagtgacaccccagtagtaatgggcacacttagcatccagattttgatttctaaataccattctccagcatccttgtagaagacatcgatcccagggttgtagccgggaaaatacaagatgaacctggaacatcttggggtacaaaattaaaggaaataatttttacgaaaatgatggggcatgccaaaggtaaacaggagccatctcaaagagctctcaaaggtcaaagctaaaaaatttgagtgcaaaatatatgatgattagattggattataaaccaataaataaaataaatacttatgtgtccaaactgacataaatatttgaataaataaattgaagagaaaggaaagcttttcccttaaaggataattccaattagtgaacgaaaaaggaataagggaagtagaaaatcatcactagaacatcacagtaataattgctatagacaagatccagttatggatgacaaatttagtggatatgttttaagaagaaacacctatttgtacagttacaaaaatctcctccaaataaatatttatcaattaccaatgaaaaaatcataacttcataatggagaaatctggaaaaagctaccttaagcaaataagcaaggttcattcacatgtaataaaacatattactgcatattagtacataagacataagacatcatatccttgatatgatacaaagataagagtgtattatttgtgtgacaatcttcccaacagtatatacattcaatctaatcaagagaaaagtgaggggtacttcatgaagttaactgaccagtactattcaaattctcaagtttattaaatttgaagaaagcctgaggaactgtcacagattgaaaaaaaccaaggaagcatgacaacttaagataacgtgggatccagggttagatcttacgactcaaagaggatattaatggaaaaattgttgaaatctgaataaagttggtagttttcttagtatgttagtttatttgttttgatcattttacttaccatagttatatgcaatgttcatattagggaaagctgggagaaggacgaaggagagctttctgtgtcacttttataatgcttttgtaagtctaaaagtatctcaaatttaaaaattaggggaaaaacaaataatcaaacaactatattaagaaatgggcaaaggacttgaatagacaattcttcaaagaagattatgaatggctaataagcatataaaatgatgcacagcatcactgataagtaggaaaatgcaaatcataagtatgagacaccacctgatacccattaggatggctactactataaaaacggaaagcacatgttggtgagaatatggagatattggaatctctgtgccctgtttgtagtaatgtaaaatggtaacgttgctttggaaaacaatatggcagttcctcataaaattaaaaatagaattactatataacccagcaattccacttctggatatatgccacaaagtattgaaagcagggtcttgaggatatatttgtatgcccatgttgacagtagcattattcataagagataaaacctggaaacaacttaagtgtccactgacagatgaatggaaaaacaaaatgtggtataaacatactatggaatattattcagcctcaaaaaggaaactctgacatacacttcaacatgaatgaatctggaagacattatgctaagtgaaacaagcaagtcacaaaaaagacaaacatgattctgcttatataaggtacctagagtactcaaaatcacagacacaaagcagaatggtagatccagggtctggggggaagaggaattgagaagatattgtttaatgggtatagaatttcagttttgtaagatgcaaagagttatagagacaaatggtggtgctgattgcacaacaatatgaatatacttagtatcactgcactgtatacttaaaaatggttgagagtaaattttatcttctgtgtaactttactacagtttaaaaaatagaaaaaaattttaaaggggaaaaacatgaccatgggcaaatatctgtgagattacaagtgtgttcaggagtttaatctggtaaattctataaaggtttatgtgacagtctcatgattttggtttttaaacttttttgacagggtacccacactaagaaaaacatttatatcttatccaagatgtttatgtgtatacttattttagttacatatatatatgtatatgtataatttattttagttacatatataactatatttatttgttatataaatatataactaaatatatataatatatataattataaaataaaatccttccttcctttccttcaacttccttccttccttccttcatcatgatgcattaaagagattttatggtctattgaagggctgacaaaaaccacttatgcgtccctaaccaaaattgaaaaacaacatttatctggtctagagtatatataaacgtgttatctgttactcaagttttcatatttcctcaacacttataactagacttgagcatcagtcactacaatgtttatcacaggtactttatgtataactaaaataaaatttaataaaacatacccttagtattcactattctctccctccctccctccctccctcccttccttccttccttccttcatcatgatgcattgaagagattttatgatctattgaagggctgacaaaaaccactaatgcgtccctaaccaaaatttgaaaaacaacatttatctggtctagagtatatataaacttgttatctgttactcaaattttcatatttccaaaacacttataactagacttgagcagcagtcactacaatgtttatcacaggtattttatatataactaaaattaaatttcataaaacttacccttagtatttccctccctccctccctccctccctccctcccttcctcccctcctcccttccttcctttgctggtcatgatacattaaagagattttatgatctactgaagggctgacaaaaaccactaatgcatccctatccaaaatttgaaaaacaaaatttatctggtctagagtgtaaataaacatgttatctgttaatcaaatttctgtatttccaaaacccttataaccagacttgagcatcagtcactacaatgtttatcacaggtacttttggaaaagtgctttgcttcataataattaccctatcagaaggcctcaatttataaagcatttagttacttagtgcttatgacgtaaatgtcacagttcaagtacttgatggagaaaaatattaaatgaagtgcacttgttttgaagataatttcatttagcatctccaaagcaggggataattaagttactctgtcatacaaaatgatggaggctttaaataagtaacagctggttaccccaatgatggagcaactgcagggcagcctttggcaaggacagctgtgcaaactcagcccacgtggtacgcaaatagacctacattatgactaaggaaatagctgaaatggaatgacatctagaaaagcaaaaaaacaacaagactgggatcccttagcatgcatttcaatagcattaagatatagaaatattaataagaagtgctcatctatcatttctgtagtcaaatgtgtttctcacgtctagacgaatttaaagttagtcattgcagggcaatgagcacattcataagaaagtaccctcatttttaaatgtaactactacttaaattactttacttactactacttttacttactactactttactccaagcaagaaattaaattcaatttattcatattttaacattagtacagtgattttttttaaagttatgctaaatctttattccaaaagtttttgtttctttaaaacctcttccacggaaatcaaatttgtaacagtgaccttaaaatgtgagagctggccttcgtaaaacaaacgtgctattaaaaatattaaataactgaccccatttttggaaagctgggtaaggctgtgctagcatggatctatcgttaaacgttttttgtttttttttttgaaaactttttattgtcactcgatctgcatgtaaacaaggaggaaaaagtgagtctgacttatgtacttgattttgtttaccagaattttgcttaagtcatactatggacctttctgacttgaaatcattttcgagttggttatcagactaactctcctaactagtatttgtattaattatttttaagcaagcatttattatcattgattatgcaagcattattgagcaagcaaatgcaaatgcaataagcatttttaagcattaactatgtgttaagcacaaggtctctgtcctgaagaagcttactagccactagacaaaatggacacagaatcaagaaatgtcataataatatggggtaacacatgacccagatttggagttcagctaacagtttcccaagggaaatgagtgcaatcaaggtcttaatagacaaatcatacataggcagcaacaacaacaacaaaaaaaaagggggtggggggcatgaaaggctttccaggggaggaaaatagcacaagctaaggcatgagggcactaaatagcacagtggggtgtgtcctcgatccccataagtaattgcaatatgtgaaatgatgagtggtgtctggggatgaaagctagaggatcttcataggggcctttatggaagtgttaaggaatgctaaagagcttggcctttgaagggatttaaagaagaattaaaatcagacctctctattatagtatagacactgggtacaagggagacaaaactgaagactaaaaaatcttcagtggttgcccctctgccaaattagcagttgttaaccttttcggcctgagaactaaaactacagtcctaagctcctggaccctcccttggccaaagggaccccagagaaaccttaaagaactgagttcctggccaagacagaatggggacatgcctcattatactccctcctttttgcagtttaaacacaattgaccagcattaatgataaactagagatgataaccaacagagcgaactcttttcatggcaataagataacaaattataaacatgacctaaggccatgcaaggcaagcattaagtcacgtacctctacacttgaagaataaactctattataactgccacaaggttttcctttttctagtaggtaaacaagccctggcctctagataagcaatataattgcagctcattcatcagacactgaccagttgaaccccccgtccaacaaaccatagctacatagctctgattgactaagagactaatttcagtaactttctcgtggtaagagaccaccaaccactgggctcagtctggcctgctctcagaggctgcacatttgaatgccttcatgctcctgcctcaccttttgacatataagacctaattgtaatgcatttaaatgtcgtttccactccaaaatgaacatgggacacatgtaacatacatgtttgttcagtatgcatgtgtcaggactccctttgtgaatatccataagacctcctcaaacctgttgaatatgtttacttggccaaccttgtcagcatatatccctgttccactctcccctccctcaaagtgccttctggtttcgcctgaaggttacacttcccagcctgtcagaatcaccatcttgaaggctggaaccattcgtaagctacatatatagatctcacaatttttaaaaatcttgatagggctcatgacccctttaaaatcttacaaaatatcgaggatacctcagtgctttgttttttgtggattacgtctgttgatatttaccatatttgaaattaaaactgagaaatatttaaacaattatgtatttatttataataacaaaggtaagcccattatatgtttaacaaggaatacattttatgaaaattacaactcaatgctggttatgactcaataaagagatcttgtgatttactgaagggcttacaaagattactaatgtgtccctatgcaaaactggaaaaacaaaatttgactagtccagagtacagataaccacaatgtgttagctgttaatcaaatgttcatatttccaaaacacttataaccagacttgagcatcagtcaccacaaattttatcagaggtactacagactagtgctctgtttcaacagtaattaccatatcaatttatcaacctcaaattataaagcattttaagttacttagtgtgcatacttagtgttcttttcaaagcaaagtgttattgaggagtggcttctttttttacatttttgcaaatatctttagttagtggcttaatagaagacaactaaattctcatattttcttctagatttaatctataagttgttttggtaaaggtttataatgaaaaccccgcttcagacacgcaatatggttgaaaaattgagacgtattttaatttttctaagagatggggtctgcaatgttgtctaggctagattcaaactcctgggctcaagcggtccctgttctcaacctcccaagtagcagggactacaggcatgtgccaccacacgagacggaagtaatattttaataactttttctgataattatagatttatttattttgatactaccctattacttgactggggtagtttctggaaggttaatggcagtgtagaagccaaaacaatgtcaatgacctttccctatactattatattaaaatccattggtcaattttgcactttaaatggatctttcatctatgcatctacttttttcatgatgatttcctaatatcatacatttctcatttggtaaacattcgtacactgagctgacagattttactatagaatataaaaaatacacttgttaatatcgtcaccaatctcaccaaaaaaagtatttaagaacggaaatgctatcaagctcatggtgatggaatacattttccaaaattctactttttgcttgaaagctcacattttatcattggcaacaaatactgtcagtttgtttctttgaagtgacaagcttactccactcattttcaaggaaatatccaccatatgtccaagtttgaataaacataattatctgtcagtcattccttcaactaaaaatggcattccatgaaaaaagcaactagatcagctttcaacctaacctcataagagcttttccttgaagcaaccatcatactttaaggattagaagttcttctttctcatcatgtagaaacctggtaaactgagatttaataaacttcataattttccttgctttatcaatagcattcagctgtaactggacagaaaaaaaaacaaaaaacaggaagttcatggtagcgaagaacagaatgactaataactgttttggtggtagtgccaacattcatattaacacactagcaattctgcccaccagtacttttgtgccagcagtgtagatgtcaactcagtgaaaaagacaaatgatggtttagtattatgatgaaaatagggttcatcgttcttcacagtccctgaaaatgtctttgggtatcctggatgtgttcaggtcacactcaggaaaatgttatgctaaaagcctcaagtctaaattcttatacctaacatccatccacaatcttgttccactctattgataaccttgagtaaaacagattttttcacttttgtaaaacacacctttttcccctctcatcttctaatttcacattcttcccaatatttacaatatataaatcattcaatcttccaggagccagtccaattcatcgccattccagatctctgaactattttctatactattggatatgtactcacttatatactatttatgatttttctttgggaattagaattatcttccaaactagattgtcagacttccagaggtgaagatttttagttcttctgactttgctatagtattctgcacagttatgcatatgataatgatgataatatcttgaattttataaatcttaattttttagtgtaggtcacaaatacacatgtgcccctattgtatttgtagggaaaacatttaatattataaattatgttatcatgtcttctactttgggtaactaatatatatcaaatatatacttaatatattatagaatatcaatttataaagcagtgtataatttcaagcatacaaatatgacaatgcagccgtatatagtggaaaaaacctaggctaggaaatagaagatctaaatttaactgtccacatagtatagacttaaagaagcacatggatttagagaagccacaaaacatatttgagtcccaatgtctgcaacagtgaaatgcttatccccgttctgatatttaaatgacgtattttatgagaaagtttttttttgaaacaatgtagtaatcaaatgcaatcttttggcatagctattaccctgagtcctgcacattaactgcaaatcaatatcagctattaacataactacatgcacagcatgacaattaaaagaactaaagacacacaatggagacatctttgagaattaaatccaagtaccttgaggtatgcagtacttgtcatagaggatgatttgaatattggcaaagtactatgtgtgcacagatttcatatataatccacataaagcaaagacgccttattacccggtattagtagtctaaatctgaaaggtgtaaagaaaaacaagactttgaagacgtattacagatttatacaggataccacaaagaaagatcttgtaaaaaatctttagacttttctttttccctttaaggttttaccctcatccacagcaaccttaatttctctgaaagttatgtgtcataattacttttatgtgttaacttaactagacttaagggatgcccagatagctggtaaaacattatttcttggtgtgtgagtgagtgtgtttcctgaagagatgagcatgcaaagcagtagacagaataaagaagatctgtcttcaccaacttaggtggacagcatccaatccagtgagggcccaaatagaaccaagacgcaaaggaagaacaaattcctccccctcccccaccagagccaagacatcagagtttctggttcttgggcctttgaactctgagaccagttactcccaacccccctgtagttttcaggccttcagcctccaactgggagtgacaccattgcccactggctttcctggttctcaagcttgcagagagcagatggtgagacttctcagtttccataactgcatatgcaaattcccatactaaatctcctcttacatatctatatctgcggcctactggttctgtttctgtggagaattctggctaatacattacccttaccaacatttgggtcttgtttatttcatctttctcctcttatccaagttctctaatatgaccacctcttcatttcagacaagcccttggtaagggcacattccctgcatgctgacaactgctgttctcttaaaaatggtagcatattctgctgaataaagccttccatcttgtttataaaatcttgaagccttaacagtggaaagactagccttagagagctttggcaatcaataatcacagcatcttgacaaaaaagggtattaataagcatgtgtcatttcttttaaaattaggttagaagaaatagatccttagagaacaagaactatgccaatggacaaacgttctagcctcctattattcagatggatatatagaggaggtggtctccatgtttcagaggtcttaggagagtggaggccccatggactctagacacacccttacacacctctgctgcctcccctgtttcagtcacaatgtttcctcacagattcttcctcccaaataaactgcctgcatgcatgtctatgtctcagacttctgctttcaggaaaactcagacaatcaccgtcttttatgcagcttacactacattgtagacttttcatataggtgatctctaattctagaataatcctagtagcctcccattttaaaaattggaaaaggtaatttaaagaggttaagtaatatgtccaaggcatagtaaattctttacagaatcctgaatgtgagtattattttcgaaccattcaactccaaacttatactctttctccttttatggtaattttgtcaataatagccaaaatgaattgaaaaccttctatatgatgtaccattggaaagaatgtttcaagtgatcagtgaagtttgttgaatctataattaccctatccaccatgatgtctgaggttgaatgtttccaaccaaactggcttatcttgaaatttcaaaaataagcactgttctacaaccgttactagcatcttatggctttcatgaagttatatactatttcacagaaacatgattttcctctccatagaccctagacaattttctcaatgtagcccatcttcttttattttaatgaaacttaatccaggactattacaaatgttcaaaaacaaaagcgttttaaaatagtgtgtctattatcttcattttacagggaactacaatgaaatggatattgtttttgtcatttacattttcataaaaactttatgtgctttttcaaagaacttcagtttaagaaaaagattattcacaaatttacagtgcttgcattttataagtatgcaaatgtaaatgtacagaacttaacaaattttacaaattttcataccgttagaagtaatggggcctcatacaaacaacaatgaatgggaaacaaagaccatgtgaattctcctgattcttttcttatagcttctgtgaacctttagccaatttattttatctttcttagccacaggtgtcatgtttgtaaaaccatgttaacaataggaaaggctgttgaaagaataaatgagataatatttggaaataactttagcaatataagaaaataatgaatctgtggatgtggaaaggatctcactgtttcctgtctagccttcaataaatttcagaatattttaatcattcatacagatcatatatatttccacaagacctgtttcctcatttatttgtttgaatcagtatctaaataggaaagtggacttcagagaagaataataaaaaagccatcccttctttcattgcatagtatcaattatgctcaattcccacaagccttaaaaattcaatgattacataattaacatttctgaataacttttatttttctttgaggcagggtctcagtctgtcacctaggctggagtacggtggtgcgatctcagcttactgcaacctcctgggctcaaatgatcctcctgctttagcctcccaagtagctgggactataggcatgcaccaccatgcctggataatttttgtatcttttttagagacggggtttcgccacgttgcccaggctggtctcaaactcctggactcaagtgattcacctgcctcagcctcacaaattgctgggattacaggtgtgagccactgcacctggcctataaggaactgtttatgtgctaggaactgtactaagatttttacattatcttaatttaatcccaacacaatcaatgagtacagtgttattattcacactatatacatgaagaactttaagatagaaaggaaattactgacttacacaagggcatggtcacagggtgattgttaaagctggcctccatctcaggttttctgtctctgaaactttgttcctactaattcacctcaagccagttctttattaatatagttgggtcacagtaactatctggtaacatttaactaaatagaattgttttcataagaattaagattcaacccatattttgaacttaggtatttttattattttggaatcactgagttaacagataaagatgtaaatagctttatagataggtattccttatatatagatttcaaaattaagtaattctgtcagatggacctcttttccttggcagaggtgatagacaatcaaaatggtaacataagcagaaatcacaagtcgacacatgatatatgcatttgaatattgcctggaaagcctctccaagtccattaaattatttttcctagggtgaatgtaaaacatatcagtatgggcaccagcacatgtgcgaagggaagaaagcattgggaaagtttgtttgtgtattgattttgttggataaagttgagaatttttgtttgttgagctttgttttgttgagctttgtttgtttttattagagaacagagtggataaaacattttcatctagtaaaactgctccactatggaatcccctttccctttttatggttaataatcttaattgatcttaatctattcaaagtggaaaatagagggtagaaagcatccagctttaagaaagcagggctatgttacaaaatgcaacagcaggactaacagcaggagagactggggtcactgtccagatacagagcacagagtatctcacatgtggtgagagagggcagagttagagcgaagaagcagagcagaggacagtgaccatgaggcttaggcggttctggctcgaagaaattgagtgaagtttctctcagacagagaagagagtagcatgtaccaaaagattaatagggatgtgctaatggagcaatgatcatctttcccggaagaacagattttaacacaagatgggactgagctgttgaaaattctatggcaaccactatgtgagaagaaaatgagtagctgtatgcaatagcacaggtctacagctgcgctacctttgactaacgcagcctccctaagtagaacatgtgaagctttgctccatcagtgactagctctgtgaccttgacagagtccctgacctctatcagggtgctttttcattttctaagttggaataataatggctaccctagagttttcaactaccaactctatatgcagttctccctaatctgtcttttacccagacatctatatggttccctctggaagggggagtaatttatctgatcagtaagattagacaaaggcactaggaatgcgtaactcagccctgccaagtttatgtttttgggatcagctggctgtagaaggctgtcatgaggagcagcttccctggcatgactggcaggggaagtcacagctctgcggagctgcttcctctctctgataatgagtctcaagaatcacactcatggccactggggaagcatggggtattaggaagccagagttcagctctctaatccaagctctactttccatcacatatttaccagtaatgaagatgaccattttctcattcatttatacctccatattaattgtgcaattggtttagagtctgtagggagacagcagcatgactgtaattctcacacactaacaactcttctgatgcaagtagtgtaaattgtcaccattttttaaagttgcaatatcaccattagctcaaatagatgcacacactacttactattatgtaaacaaaacatcatttcaaacaatcttagagaatgtctgcaaaccacacgcaggttgtcagtcatacacttaattctaatgattttcaggtagctttaggagccctatcatctatgacatgataaagacatccaaaaattcaagtcttgatgttaatcatttatatttttatctctttaaataaacaaaaacagtaaaatatgagcccagagaagaagcatagtaactgattgcaagcacttagaaaatgcttgaggaagacaggtaaatctttgacactctacttattttctttttatttcaaagagctcctagtacatttctgcatacattacacacacacacaaagacagaaagtaacaaaacacttcaagtcttcaaaaatagaattgtacatttgaatgccatagccactgccactgttaaaaatgcagaatttcaaattgcacttttcttgaaaatacattgatactctgctggcttagtttactaaaatcacaaaatacaacgcctaagagtgtacaaaatacattccctttgaagaaaactgaacattggaaaatactatatacttggttaaaatagatgactgctcgtgaatatgttcaattaagttcaaagcaaaataatttcctaagatctcttattaatggactttataataccaaaaacattaaattaaaaatcaattaaacaaataaaatgcaacccttacatattaaataactgtttaatctttcaagtggatatgacctattaataatagaagcatttgcaaactgtgcaacagttctggtacagagccaggtccaaggctaagaggtcaggaaaaaaataagaatatgacagtcccatggcatgaagttaggcatctgaaaacgtgtgtgctccaaaacagaggtcagttaatggaaaattttagaagagaaagttgggttagagccagcacagcaagctgaaatctgctcttacctaactggcaaagtcagaccagaaatacaagcaagaataagaaagacacaaatattttagaactaaatgaggtaagtagactaaaatccattaattgggggatgctactgagaagactgcaatgatgacagtacagcaatcagaaaagatgtgacacatccagaaggatctcaaggccttttatcatttttattctaattttgatattgagctgaacttggagtagaaaccaactacccaggaacttaaatgtagaattctaattgggatttccagtttgggtaagggagtatatgaatacacagtgcctgctgagtaacaagttttaaattattatttttcatctggtcctcatcattaggggtatcaaaagttttgtttgtaaagacagcaactatctggttaaattcttatactgagaacgaatgtgtaaagatcagctcagcctactcatgtgacaattgttaatgaatccattaactcatatctttctgcttcttaagcacatatttaaatatgcataaatgtgtgtgtgtttgggtaatgagaaaaatttgttggcaaggtggctaacgaaaatatccaatctcactaggcatacgtgcatgctgataaaattgtttgcacagtaactgttggtagattcaaacaactacttcagagtagaagctcaaagccaaatacttcaaaactgaagggactgaattcagtggtcttctaactggattccacagggctccagagtcctgagctacttgatgaatgttagggtgggggtagtaaataggactctgactctctgagctctgtttcttctattttacacttagagtttcagagagattttattttggaaataatttttgctactaaaaacaaaaggaatgcagaaaggaaaggacagagagaaagggaggaaggaaggaagaaagggagacagtgtggaaggaaggatggatatacggaagaaaggaaggaggtaggagggaaggaaagaaggaaagggaagaaacgaaagagaatctgcagattttatagattagataaatgaggtctacataccttaagtgacatttcacacattcctgacacaggtagaactaaaactcagtcttccttattcttctatgacaagaagtattgatggctccatttgtgcttttagaagagaagttctcagatttttttgagccaaaggtttcaatagttccactactgtgaaaccaagacacatctgtcacttgcacttagatgctaacagacttttctgaacgaggaaatgttcactggaaccatgttttttgccatcgttttttactagaatatctaatttgtcaacctctccctttgaaggtaaaatcatccagaggtcagttgcacttaaactatgattatcactcaataactcggtggctttggacaagttcttccctgtctaatcagttgcagaactagtaggatggttgtaggagaaattggggtgatgtagttaaatcacttgagtgtttctcaattgatttctcacattgttcctcacaaaaaagcctttttagacattattttcctaatctcccccccacaggtgaaatttaaacagcatacatgcactgtatacctctttatgtactgaatgcatatctgtgctttattcataataagagaatgagttttggattttttttttttttttgctgctgctgtgcaaataaccaattttaatccctttgggggcaataatgttatcattgagaaggtatgaaataggctaatatttaataccatacacaaatagcaagggttgggcatagtgattatgagccaatttcagcgtgtggatagaatgcagagtaccagagagccaacatccctccaaaataaaagatgcagcagattacagaaagatgatgggggcacacatgagaaatactactaattattacagtaatgtgtactgtactatgctttcaactttacatttgccaattcattaattttcttaaaagccttaaaaactatttaaatatgaggaaacttgggagcaacaacagtggatggagggccatccttcaaacctgggtatgtctgtctccaaaattcagggtattttcattagcactctgacatctaacttggcattttaagctgcaactgcctgaagttactaatttctaaagagggattcactggctattcttgtcaaatgactggctgtgtatgtagatatattcgaaataatattagatggtcccagttggaactgccctgcctggacattctccttggcctgttgatgtccttgccccatttctgtcattataacaacccaataattggtttaacctcttaaaattattctagatggaatggtttttatcccctatgaatacattacaatctttctgtaaatggtaaatgtaaaacttaagggctgcattgcaacgttgggttaaacccgtatgtactgatgtataaatgtgagtcttaaatgataggcagtagtaacctatgatgctgagagtgccctattataaaacggagggagaaatgggcatcagtagatcagccatgaaagacaagcattaaagggcatttgtcagtagagtgtaggtggggacctcttgcttcttgaatggaacataaagtgcaagggaataattggagtgcaacagaaatacatttttagatgagggctagaaaatcaagcctaagacaaagaaatcccttgaccctgaaatatctcctagagaagaaaaggatggattctggaaacttaaggaactcagacacaagtctccaagggttagataatttcatgatgagaggtggggtctgaagccataaaaattcttggaaattaccaaaagacataggagagctgtgtatacggagggacagctttgcatattgaagctgcaagtactttaagaaactcaattgttctgatgtatatttgtacctagaaaactgtttcttataaagaaaggaaaaaagaaacatcttgactgctcatgcatgataaactgtgtgggatcaagtaaaggaagatagtattaagggccaaagagaggcataagctctttctcaggaccataaaagcaagggtattagcctttgacccatgaccattagtgggggcctcagaagattctgctttctgcaagagtacctggtttccagggtaccattttaatagaccatagcatgggaagccccttgctggcataccatcatagacaactgaaaacggctctacagaaaacactcactcacacaggaggcagtaagtctccagaaaagtggggggacatgtactgttggctgtctctattgcttttgtctgattaatgagctggcagttgatggtaaatattttatagcataatttacttcttcactttttccaccttacttctgccctgtgctttaccaatatattcaagcttcattggcagtacctgtaaaagacaagctctaatggacataatgtagctaatgtgtcaaattaggactttcattatgtgaaatttgattatgggtcataaattacgtatttatcttgcattaactgatgaaggtaacttgttaattagatgaaatcaaagttattgacctatagtgaatctcttctacatttattgttggcataaaataaaatatcatgacaagaatacaaatgcatatttattttgttactagatatgtaacattttttaaaaattcctgggagaacagatgtgaaatttgggagaatctatgagagatttactcagaattcatatttattatcttttccgtttatgaagttgttgtctctcaacaaacctctccaaatttgaatctctccaaatccactcttctatatactctgtttgtggtgctgggggaagagtgtctgcaaactacatttttttttttattttcttaaggttctattttatttttaattaacaaaccacaatgagatgtcaccttctacctgttagattagctattatcaaaagatgaaagagcttaaatgttggcaaggatgtgtagaaaaggaaacccttctatactcactgttggtgatattgtaaattagtaaaaccattttggaaaatagtatagaggttcctccaaaaaaaaaaaaactagaattatcgtatgatccaacaatcttactactaggtatagacccaaagaaaatgacatcggtatgatgaagggatgtctgcactcccgtgttcattaaagcattattcacaatagtcaacctaagtgttgtttccatttgagtatttctacacagtgaaatactattcggcctttaaaaaaaagggaatgtctgttatttgtgacaacatggatgagctgggagatatgttaagttaaatgagccaggcacagagagaaaaatatcatctgatctcacttatgcgtggaatttaaaaacgtcatagaagacaatctaaagaactcatagaagtagagagtagaatggtggttaccagaggctggggggaggtgggtggatggggaaaaaggaaatgttggtcaattagattggagacataagttctagtgatttactgcacagcaaggtaattatagttaataacactgtattctatatatacaattactttgttaattaaaaataaaactaaaaacaacaattgtatatatttatggggcgtgatgttttgatatgtgcgtatatacatatatacgtagaaagatcaaatcaggctaattaacatatttatcacctcaagtacttatgatttctttatgatgaagacatttaaagtccactctttcagccattttgaaatgtacaatacattcttattaactatagtcaccttgctgtacaatagaacaccagaacctagtcctcctgtcttactgaaattttgtgccctttcatcaacatttccccttttcctgtcctctctcccctgccccctcaacctctggtaaccaccattctactctctatataaattccacttttgtaagttccatctgcaggtttcttcttgttagttggatttctgctttgttcttcgaatagaaggtgctagagggagatggaagacaggaggagagaagggatttttcccttccagagtcccagcaacaacccttaacccaacagcaacttttgcttctggtcttcaattcctgtcatcctcctaaagggtttcatgtacctccccataagaactggcacagttggcagcattcttcctcagaggactaagctctacctctggtacttagaggaaagatcagagatcagaacaatatgtttggaaaagaacagtaggaaggaaaacaatgcatgaaaaatattcagttaaaatattcagtaagtttaatatgtaaaaaatactcagcacggtgtttggcatgtagtaataaatgtgaataagtgtgaccaattattatacagcagaggctcagcttctgttagtcatctatagaggttttccttacatagcttttaatgcattatgatatacattaggaggtaatgtatcaaccaaaagggggtttgactttttaattgaataatgtcaaattaacatagtatgaatgtttgcttattttgtagaccattaagctatttgctatttgttatgctctcccttagtctttgtttatcaaatcacatgtttattttttctgaccctttataaactattttagaacagtcctttattcttataattttttagtgctttctaaaatgctgcttacatacaataataaatgtacttatttgaattatggtaagacttcatactcatatcatgtattttatgagtgtatttccaaaacttctgcatgaattacttacgttttacagcagaactagttacaaaagtaaatgctaatacttccattctacagatttttaaaaattaagtacagaagtggaaaatgattttttaaaaggcaaaggatagtcaaaggagcagggcttcattatggaggcacattgaacattggctacccaaaaatcaacttttcagttgattttttcaaccatcacattttctgaattttcaaacaaaaaatagttggaaggggaaacaaatgtgttcatcacatatcagactactcatatgatcccagctgagaagaaccaagactccaaaagatacctgcactgagactggttaaccatgtgaagccttagaagcactggcaaagtggcagtcagtgaagaagaaagaggaaaagacaatagaagaaaagggagaaggctgacaggtcagcaacagtggcagagataatatttcttagaaacaacagtgagtaaacaacattaaataagagcaaatacttgtcattggggatttgggaaaactttgaatcaggccggacaagttctagagacttagctaactcttcaagagatccaaatctcaagtcagagagcaggttcaggcagggtggcagttggtgtctgacagtataactatcaatgaaggctgctacaagaagggagaatgagtgtcaatggggtccaggaagagtcggggcaggtctgggcaggccaactgtcagcagtacagattttaatcagccagaaggacctgggtgtagtggcagggtgcctattacagaaatgatcaatgcctggtagatacaggtgctcatagaatgtttgcagggcttgataacttgatatgatttacttttttagagcaaaaaccagcagcaaggttggattgattacagttaccatatgacctgttgggattagatataaacttttggtcctaatggagaagaacctgtcattataaggctaagtgaggttgtctttaaatgtttgggatgcaaaggctagaaatgttcattctaagaatgaaacataaaaaagaaaaaaagacttgtaatttagtgatcacttgagaatggaagaaaatgacaaacagctacctgtcctttaatgttacaccatctctacagtgacaagctaagtacccacatatatggtggcatgtttgagaggtatgcaagggcagcacaatcaaaacaaatgtagtttagaagcctccctctaagatctgtttacaggaggaggggagaaagaagtttccaaatctacctgcttaaagtgttacagatagatccgattgcttagttctccctctaatccacaaaagtgtctgctatatacaaaaatatactaattttagagaaaaatatgaatatttgcatttgacttcaaaagaaagtttgctaaaatatttacagaagaggaaaacattggtttatgtactgagattgtttcagtaaaactctgcagatacctggtgttttaaaacaattatatagtacaaactagagcttctggttcttattccttatgatttattcttggtaaatgacttgagaatgcttttaattccaccttaatggttatttaaaacattttaaaaattagaggcataaaaatgctgctgactggatgtgtactttataatacataatttggggtgtccaatatggactcagagttaaaagagtagacataattattaaacatgatccacagacataggttgaagggacctttctgtttctatgggaacagtcctgtgctccatattccagctggttccagtggtgctgttaagcaaagactcttcctggatgtcagcacaggaatgatcatgagtctcaagcctttcatgaggacctcattcctatggcaagtgggattggttcactgctagggaatgagactcaaacaagatcaaccaaagtgatttccaggaatggagacagtatttatcttcctactagagtcactgaaacaggaggaaatgatctgggattgctagccttcatcttctcctgtcatcaagcagcagcatatctggatctgggggaatgaggctcacatgattaaaataaaataaaataaaaagcaaaagtacagcaaagagagggacaagatggagaaggcagtcatgccagagtacacaaatataagatgaatatgagttgtatctctggaaaagcctgatcagacatgagactgtttctgtaactaattagactagtatttctttcataaaccaaactttcgaaagcagaagatccaaattacttatattttatgaggattagtttgggattatcaaatattgacatgagcacaggactagaaggctaggaaaatctggcaagcctttttttcattgttgttagcaattgtttcattgttgttagcaaatctgttgttagcagatattgtggtactttattcataaatctggcatatttacaaaaaaaggtttaaaatcttttagcttaatgtgtacttcagaaatatgcattatatagtaaaattttaaaatagtctgtacattaaaaaattcttataaagttaacatccatgacagagatagttgccactcaccaaatagcagtgtgtattaggccctccttccccaggtctcatgtagacaggggagttgtgtagctaggtcacaccagtgacatctgagcagaagtggcatctatcacttacgggctgaggcattcaagagccactgtttgattctctagctctctgctttcaccttccagatggaagcatttctcattgcccattgatcacatgaaggatgtggctctggaaggtctcctaattcaccgcagtctttgcatgaattaaaacaaacaaaaaataacttctgttcttacgagccactgagaattaggggttgttctgttaccccttcactaacagtctatcttcactaatattttcctttttattgcccatctcatttttctcatggagtttggtttgataatatctgggtgagacactttcaaaagccattttggaaatgtacacgtgatttacagacactctattttcacagaatcatatgtctttataattatcaaatgttttataatgactgactagtcaagatgtgcatattacattttaacaagatacagccccttattaaatgtaaaagaaaacattttaaaattcactattagtttcctattctcatattaattcagtgtttcatctgttattataagtcaaaatgtccttccttgaaaacatggactttttctactgatttatttatttcctattttctacatttatggtgataatgtgtatgtatggtgccagtgtactgatgactttgctgatgacttttaattttttatgtatcaatagacatataaaatgagaacttaaaacctatctactgggtactatgcctattacctgagtggtgaaataatctgtctaccaaacccccatgacacacaatttacctatataacaaacctgcacatgtgcccctgaacccaaaataaaagtttttaaaaattacatctttaatcaatcaatgcaccagttatttttcaatttttctgctaaaatcacatatgctggtgataaaaataaatgaatatatgacattaattgattgcccctgaatattttttccagtaacatatttaccagtgtttacacaggataatcatgattgggtgccccaaattttacaacagtgctctggaaaagagcttcttgcccactaatttccaaataactaaatttttattactaactataatacaaaatatcaaaatcacaagttaacaagcatgaataactggtagtggagccaagttatagaggtttttcattccaagaaggaaaaatggagggcttcaattgcacagttggagtcattcttcagtttcaagtgttcaaagtggaatagtgaacagaagaagcaattcttgtcaccaattaggctacatattgacggatgcaagcaaaccttcactaggactaaaatggatttggtgtataagcagacttatagacatataaaaaccacaacagttctgcgttccttcttgcaacacccaaatttactttagtgtcttaattctgtaggcttataataaatctaaccactaattaacatgaacactaattagaatggccccaagttaataccttaagtatcttctcgaatagacagactttagctctttccatggatttcttacagaatgtataaattcataagtgttttgcccccatttacacatccccaatctaaaaatggtccttactcaatgaaggctaattcagacaagtggtggccagagaactcctcagaatctaggacaagaactgaggttccccaaactaaatggagcaagaaaggagcaattgctctgcaaactacttttacctgtacatagttgaaggtaaataaagtcctaacaaggaaaattgaggtaaacaaaccttaggtccagtctgccctttctagatgtctcctgccccgctttatataatttttagaagttttaatctgctttttaagaacagcttgttgaagtataattgtcaaataaaaactgcatatattcaaggtgtaaaacttgacatcttgatatagatatacgttttgaaatgatcaccgcaatttagctaattaacatatccatcacctaacatatttaatattttctcttttttattcctgtggtgagaacacttaagatctacgctcttagaaaatttcaagtatataataggtgttgctaactatattcaccatgctgtacattaggggtcaagaacttatcttgcataactgaaacttcgcatcttttgccctgtctccccattcctctcctcctcctagcccctgtcaaccaccatgctactctctgcttctttcagtctgactattttctattccacatataagtgagatcatacagtatttgtctttctgtgtctggcttatttcacttagcatagtatcctccaggttcatctaacattgttgcaaatggcaggcttttcttcttttttaaggctggataaaattccactgcgtatatgtgtatacacacgtatgattgtgtgtgtgtgtgtagacatacgtgtatctacacacacacacatatatatgtcacattttgtttatccactcatccatcagtgagcatttaggttttccctacatgactttatgatgcttctttcaaatgtactccctacaaaactcttaccttcacgatgtggacattagatctactgcctattctgactgcaaacttccagaagggactattctttcccagaaaaccccttcccacctctgaaaattatactcatcatttaagcctcaataatttattcaataaacatttcctccccagcaccttgagaggcccaggcgggcagatcacttgaggtcaggagtttgagaccagtctggccaacatggtaaaaccctttccccactaaaaatacaataatagccaggcatggtggtgcgcacctgtaaccccagctacttgagaggctgaagcacgagaatcacttgagcccaggaaacaaaggttgccgagagctgagatcacaccagtgcactctagcctgggcaacagagtaagactctgtctcaaaagaaaaaaaaaagaaaaagaaaaaaagaaacatttcttcaacctctctctgtgcttcctctgctaggcaacaggatatgtatgtaactgaaaggcaactcttcccttcaaggaaataacaatctaggggtgaagacacagatgcaaactgatatgtaaaataaaatgcagtaaattacataggcagggcatacaaaatatgtcacagatatgcaaggagagggcatatctaaagaggctctcaatgaagccttccaaatcacctacagccaaataagtggtcctcctacttttactttccgcaagtaattttctcgtggcaatatgctttcttgtggcaatctaaagaggctctcaatgaagccttccaaatcacctacagccaaataagtggtcctcctacttttactttccgcaagtaattttcttgtggcaatatgctttctgataaagaaatgatgtcagaagccagacagcatgtcttcaaatcccagctctgtcactcacctatctttgtgacctcaggcaaatcacctcctttctggagatgtcaatttatctatctcatttataaaattgaataaaaatagcacgtcttatggtgtcagtgtgaggatgaacttgtgtcatgaacagcagtgtctggcacttagtaattacttaacaaatattggctacaaatatatcatttttctcatctacaatcaattagagtttgttattagcataactatgacctgtaataaattataatttctttgggtgaatttatccatattgccaaattgcaaaaagtagagctttaataattgattctttactggtacttttttctgtctaaactcctgaagtcttctctttctctgaaatctaatttgtatttgcctttcactattggcaacattaaagtatcaacttccctttgatgaaggtccgcagcccagggcctgaatggaacatctgctcttattaacaattccttctttttcgagcttgtctattcttttagagcaacttggccctaaataccccctaacacctcatcttcaaccctaattccctgtatggccctcccccaagttttccatgacttcagtctgttcaacaacaactccatttctattagtccaatcatctctggggtctgggttctctctctccccatcccctctgttcatttcgaaaccctctatgtttccactgttttactcaaagtaatgagtaagtacctgcactggcaggacaagtatagaacgtcaacaagtgaagatgttcaataaaccctcatcatagagtattcattaattatgattgaagaagtaatctacacctccaacttcagcttctggcctaaattacatttttatacctttgtatattatatttttgtatattattatctcagtttgttttgtgttgctataatagaataccacagactgggtaatttatcaaaacacacacacactggcacacacacacacacacacgcaaacacacattgatttctcacagttctggggggctgaaaaatccaagatcaaagagctgttatcttgtaaaggccctcttgctgtgtcatcacatggtagaaagtagaatgacaaaagagagagcccattcctaaaagcccatttaaaaatgatattcctccattcatgaggatggaacctcatgacctaaacacctcccatgaggccccacatcccaatactgttactttggcaattaaatctcaacatgagttttggaggtgacaaacattccaaccatggcaacaataaatgaatgagatttgttttagtgcagtaaaattatttgttgtatttttcagtaatatttagagaaaagcttatttcagcagaagcaataaatgtgttataaatgatccttccaaacatttatacttataattgtcaagcacagccatctaataagagttgaaaggtaaattagttaggaaaactgggttgcctctcaaataaataatctagcatgtgttttgaagaatgaatgacgtatataaggaagagtttagaggaacttttcaatcctagaatggcataaaatatatgaagctctgtcacacttcataaatcagtactgttagtagatccatgtcagacagcaactgtgtttgcaagtaccaacgtaattataaatggagggcatcaccaggagtggttctacacagatctgacccaggtgatttacaaaaaggttgtctctccataacatatacttggatgcagtcacttacatttgctaattgctactgtttcctaattattcctgggagcaagagggacaaatgatgcccagaataaatttgaaaagcatattggaactctgaagacaggggcagaaaagtgaatattttaggataaacatttttaacacctttttcttccaaaaagtgttaaattttcaatatggttaaaatatcgaaataggtaggttattgctgcaagagaatggttggcttcatagctaatatcacatagtggaattttgacttctgggatgtggcttatgacaccagaaagacagacacttgaggcaataaaggtcattatttttgagattcagaaactatatatttgtccaggtaatggctgatacgcacataaataaattgaacgtggagaggagtgatgaataaaagcccacattcagttgtgaaataaattacaaattgagcacattatgaagacaaatacactgtagaaagcacattaaaacaaagtaataataaaagtattattacaaatcagtgaatgattactatatcccaggcacttgaaggtatctgattcaatgccccagtatccctttgaggtaggtaattatcacctccaattacacagattttttaaaatgaggcttaattgatttaaatcttgctaaaattctcagagctagcaaatgatagagataaaatttgaaatcaggaccatctgattgcacagttcatcatgatacctagacatttaggagaaaatattggagaaatgggcaggaaaagtcctaaatgacctcagacacctctacacataggacataggtaataaataaaataaaattgtgatgataacaggtgagaaatagaacttcatagatgcaaataagatctgaaaaataggacaattattcccattgttgtcattccggcaataccagaagaggaagctttaagcacatacacacacatgcacacatgatgtctattagaaagaaaggtaaaattgtctgcaagtccagatgacatgcacctgtagcaatactgagttccctctgggaaggatatgaatgaggtattcccaacatgatcacaaagttgcggcatgcttttaatctatagctgcacatttcttttggcagaaagaagactcttctaagttcttccctaaataatacagcaatattttatgagctttaaaaaagtatacaaatgacactggacactatccatggctcagcagaagtacactttaaagacacataggttttagcaaaaaaaaaaaaaaaatgaactcaatatgatttaagagttgatatggcttccaaataaaagatgatgtgatgtgatcgtagtattcattaagagatctatctaatctagttccctgagagaactgacctgtgctagtccaatatctcttggcatactctgcttcattcttgtcaaagatttcaagagggatttattgaacatttaaaatggaaaaaaccagaatatctgaaggacttttgaaggaaataagcatgtttaaagtgaaaataaatttcaaagaaccatggtggctaccctcaaatatgtaaagaattgattgattgccacgtggaagagggttagaattttttatggccaactatgttatacattagcttggaagataaagagcttctagttactggaggcatttaggcatcatctgaactgatgcattggttagcatcactttttagtgagtaattggactcagtgtcttttaagagctctctcagtgctgacactgtactctgcacatattccttcactgccctccatgtgacattggcacatatttgtgaaatattttgaccaaaattagaagtaagtctttagagataactagcttgagggcttgcaatagagctacatggagatttaatcagtggccttggactcattagcgccacatcctccaaacctggctcttacatagtcatggtcaaagtgtgttggtgaagcagacaggtaagaagccatctgaagatattcttacaattcatactcatctacatattgagaagtctgccttttctttttctctatggagatatctataagcaggtagtgggttgtagggagatcagtactgccagtagcagctatcccatggtcttcacgtagttgggagactcactaagacgaagctcagtgaaaatttcagggctgtgctgtttattatggtctgctatggtatgatcacccaccacttctggtttacacctatatcaaattccaacagctgctgagcctgagtaagtcataaatataatgaactttgacatgactgaaggaaagttaatttgaattatatcatctcagcaatacatctccttgagaattttagaataaaaacatcctcaacaaatctatagacaacatggcaattttatatacctcttgtggttttcaaatcattcttccctccaaggccaattgtgatgagggtgactctatgggttatgtcttttattccattgaaggcaagttatcataaggctagttaccagaggaaagttaccaccaaggagatgaagagcatgtgcttcaatgaatgactgtgttaacagtgtgttaatcagaacaagtactaggaaaagtgggaatttaaatgtggcacaaaggccaaggcatgcaccaatgtaaatttagaaaactgtcgagaaaatatgtatggttactgctggaaataattcttcagccaatttggtaaaactctaagtgttaaagtgatgagagatccaatgggaaatctctagagtttggctgtgagttataaagttcataagaatgccaaaaaggccaaagaaaaaataaaagtaaaataaattagttgcaaaatcatatgtggggttggatctaaaggaaagttgaacacatagaaaactgagttaaaacaaacttttaagtcctgaaaaggcagagaattagccggtgtaggaagctgagtctcaaaattaaggatcttgataactctatggaaacaaaaagttaagaaaggcattttctgcttatagattaataaccagtattggaggagagaaacatagcaattcagatctgtttcccttctcccccagcagagaggatgaaaattggccattgtgtatacctccccagactcactgtatacctccccagaggaagttagagaataagattgacctgatcaactggtatattcagctatggctggaaagagagagttcccaggcaatcccattattaactgtgctggtggctactttgtgcagattccctataggctcagaacagacctccatattattccctgatagtctgattcaaatgagatcccatatttcctggtaggagaacatggttaacaaggtgccgtatgccagtctgagccacactctcgacacctgacctctcaacaaatggtgctgcagcctcttgtggcctccccgttattgctcacaccatcaatccctctgtggtataaaacggaaccatccagtatgtgctccaaatcctaggctgtgactctgcctgatgcccccagcttgggatacaaactccacagacatcataatctacagctgaaacacaggtataagaggctttggacatttccaggctgcctcagcactccttcaaaagcaaaatcaaagaataagaaaatgtttatcctgaccatccaaaccatgcatataaggttgaatggaaagatttgggaatagtgctgagatgaatgacttggaattgctacacctgctggagtttattccactccaaaatgtctttattccatcaggaagggaactgccctggaaataggtgctgttactggggccatctcttaggcaggaaaaaattcagacaccaacaaaagccagattatagctcattgtctgtgacttgatagattgaagacagaccattattttcatggaccacaacaccaaaagctacaaatggcagagccaatatatccttttgtttcaaaatgtcaactataaaaagcctagagttttcctatcattaccacttttctggatacctgtatgtttcagacaatggaattattttctctgtaggcttttaaaaataagtctttaaaaattggtctaatatgttgtaccaaagtctgtcaattaagaaataaagctcttgtttttaaaaaaaaagagtcatggaaacaatttctaaaatccatatgctttaaaacctgcagtaagatcatattgtttagaatgaatgtgtgtggtcttcttacctgacccttcgggtattttttttttaagaatcccaggacaagcatgtgtagtgataaaaacagcaaacactacacggatatttcaccaaaggctggtgaaactcaggatagttaaactagatagctttcatttccatcactggctctacctaatgttagtatatttcttaaaccaggacttcttaggaagttcagtgggcactagcaaatctgcactatgcaactggaagaaacttgtatacatagccactttccagtcttggctaacaccatcagcacaatgtcagcttattttccacttccggttgctctactgtctgttatcatcatgttgacacagcatacatttcccttcattatcacctctctccttacttttatacttaggtaagtaggactgaagtcaagtgaaacctgttttttaggttatgaaataaagagagattagaaatactgagaacatgggtagtaagagaaggaggacttagagacctgtttgtctatattaattctccatcagcctaaatagattaaatactgattccaaattgattataatcagaggtgtatactaccaaacactgaattactctctcttcataaatgaaaactgcctacatgtagctttttatcggagttctttttaggtgtttcaagaacaaaattttaatcatcaggttctaaaaagaaacaaagtagagagaacagagtcagcctcatttgtgcaatcatgcatttgttcatttcttcaaataaaatgtcctgcttacctattatattgtcaagcacagtgctgggtacaggaaacacagagatgaggaaaataagtatcccagtgcctatggagatgagcatttagtgacttaaatagccccagcaagtccgcagatgctggagttgtggtccatctgtttttgtttctctcattgacttgcaattgggataccaacaagaaatctgatattactccatgtgaaggacgatgcatccaatttctatgtggttttataggagcctagttcaataaagctgtagtgaatgcttaaaatgaagcagtgggtatggcttaaacaatttggactttggagacattaggcttcaaaaccaaacttgcatttaaatccctgttttacaactcacaaattccatgaaactgttttactatcagaaaaatgggtgaatatttatgaaatgatctttgtataactgtggtcaaagtatgcattagcatgtgtattcttctctttctctaagcttttactcaacaccttgaggacagagaatgcaaaactatataagatcaggaatacaggaagataacacacggcaagaggaactttgaatatgactttaaaacattttacacccaagaaaatatcaatgcttataaaattaaataaaaactgtatatagagatgaataagaatatatatttagataatacattttagataaaaatgtatatctctaggcattgttcattaccattctcattgtactaattaaaattctaaatattatttggaggggttaatatttctgtatcaaccaaattctaagaattttttagtattacattgaatgtttgataggaatttatttctagagtttaaaaatgagctagcaaactcaacttgtattgtactagcaatagtacacttactaaattattataattacatattgcaatccttataatctatttgtttctttaaaattattatatgaaggtctcccatatttatcacacgagtatctgatataaatgtgtgtgttggggggtatgtaaaatatacaactttcatttgacttgtattttggattttgttcttttgtttttgcaatggctatatcttaatttcatcatatatcataattgaaattggtttgcaaattttcttcaaagttatatatcttcatttactatacacatgatcaaatgtgaattaggatgcttaatgcatagtatatcagcttaatatgccatgtttcaaattgtacattcatatcctttgaaaaatgtttaagattaaacacatttttaaaatcatcattattattataagataatcttaagggattgtatgtcatgtctaaaaacagtagaaaattatacaaaaagtcatctaaatcaataatgtacacagtatttacttactgtataagtttcctattgctgttataacaaaattaccagaaactcagcagcctaaaacaacacaaagtcactgccctgcagttttggagtcaaaacttggctccaaatgggtctcacttggctaaaatcaaattagcagcaagattgcattgcttttggaggccttagagcggaacctgtgttctcacctttttcatcttttagaggctgttttctgcattccttggctcatggccccttccatcttcaaagccagcaatgacaagttgagtctttctcaggtcgcactactgactcttctgcctccctcttccatatctgagacacaaccggataatttaggataacctccttattttaaggtcagttgattagcagccttgattccatctattactttaattcctttttgacatttaatatattatattcacaggttctggtgattagaatgttcacatctttgggaggcccttattctgcttaacacaactatttactgttgaattttatgccatctattcaaggaacactggtctactttatatattttattctaatttaagcaatatttgtatgattaatgtttttatgccttaaatgtatttgtagaattttattaaattcttatagcaagtatttcagtattccaactttttgtttgttgtttatgattcatcttatcaatctactctcatcaacctagaatacagttgctggataaaatacaggacatccagttacattttaatttcagataattatattttaggatgccactttgtatgacacatttacacaaaataattatccattgtttatctgaaattaaaatttaacataacatctgcatttctatttaataagtctagcaaccctatcctaggaaaccctgaacattgttcctctgtagaactgaaaaagaatttgtgggatcatctgttaagacctcttatggagaactgagacccaaatacaactgcagttgatgttggaatggtttcaaatagaagcagaaggtattttttttcagaattttaaatgactcaaaataaatatttggccaacagaaatcagaaagaagcatgctgctattgcatgaaattaaactaagcaagcatctatgatttcctgacagaaagtatgcttccagtaggatagcagcaagaaagagagccctttggtataatacctgattacatggcaccactttaaattagtgtaatattctaagaaagagaacatgggaggcaatttgagaaataagccatgatttaggaattcatagtataagtggaccaaatagaaaatactgttacttgtatatatcttactttatctaagatatttaagatatctcaaagttaatttcaactatggttgttttgctccagaaaataaattgtttatgctttttaatcaaatactgcaaatatatgaattcttttaaaaaaacacatatttaaagatttcttgacagactatgttattagagtgtggagaatagaaaaaaaagtcttataaacaaatcatgttataacatatctctttctacttagtcatattacggtcataaaaataattttactttaaatacaaaacaatttagtaattgatattaaataattgggctcaattccattaaatcacatgaaaatatgaaacattttgtgtctgtttagggccagttttacaccagaagagtacaatgcttataggtactatagttactgcagatttacataacaagaatataaacttaacatttctcaagtgaccaaatgcatcagcaaaaaagtagggacagcagagtttagagaatgccaaagggatttaggttggtcagtatggcaaatgaagactcgtcatctcacttaccaacaaacgagtaagaagaagcaggagtcttagtcaatactcaaaccaatcctgtgtgctgagcattgtttttatccccattttacagacacgagctgaggcttagagtgggaatatatgccacgtcacttagtacatgcccaaaccacaatttgtgtcaagcatccagtctctacatccatgcttataaacactataccatgctgcctccatgcaattaaactgaatgtgatttaattgctcaagttgttatgttaaacagtgtaaagtttgtaactatcacacattgtgatcagttaaaattgattatataaaatattatgtgtgttgtgaatatggcctttatttttcaaaataatcaaaacttatttcaacttgcactaatatcttcatagagctcctggataatggcataagagtttggggaattaagattctggagaaaagcacctgcttttgaaggtttcaagtctaagggaaataattattttagatagattgccccataggattttcaaccaaaggaagagaactcgtcacctatatggtttccatatttgaattaagtcttaaactatcatgaatttatttttaagaaaattacagcttttcttgttcccaattacaaaagtactttaaagtgttggctttttcttaggttccataggaagagtcaagagaaaaagacataaaagggaacttaactggttcttgtcaccaacactttacaatttgtcatgacaggactgcttagtagacacaatgtccttccctcttttttagccattgaggcagagcaatttatgatactacattaactggcagtatgaggaaaacgtggtagaagaggataaggaactcgctaatgtgaagcgaaataaaaaatgagtttctaataagagattactttacacaataacttttctggggtcacatcagtcttccagcttgtggcttatgtatttccataagaggaaaaacattttgaatgacaaacaagaagtaatgatgagtagaatgtgccacagaaaagttaggtaatgttcaactagcaaaatctgatatactgagaggtatctgctgtgggctatacttttatttttgcaaatagagagcaagaaatttataaattaatgtaaagtactgagtactgggcatcctttttctctttctgcctaagatagctcataaaacataaacatatggttatcaatagataccccatagggctcttgggaaaagtaattcggattctggatcatacgtttgtatcatgctatgttgatgtgaatgcaattgattaaggtttatgagaccaataatccaccttaagtatatttatcttctaaaatgcttcctgcattaatttgcatctctcactgaatatgcataataatcttcatgtgcatttgcttaaaaattaggtcatgcctctgagtagttgaccatttcttatgtagctggcatttttttttctaaaataagagcatcttagaattaaacagacccttagagactacctagtcaagttctcatcttacttgaggtaagaggacaagattcagagaagataacttccttaatcaagtccacagatatgttaatgagaaaagaatctcaatttcttgtctaccaggccaatcatttcctttacttttaactttaactcactttttagaacacattaactcagaattggcttaaaaatgtttatccctttttcttttctttttatcaatttcaacaaaaaccttgtacttgaaaactagttgcaaagcacttggattgtggggctggcaagaagtgagagttgggaagaatgcacaagaattatgatgatctcttcctgaggaatcgctgaatggaaatacaaccatagttgcataaataactgaagaacaacacagaacacaaatctggaaatgtaaaataatggacatccagatagagcacatatgtgtttagaacttgtattaatagggaagatttcatggattagttgatttcataagaaaattggtttcactgaaatgaagagtggtataacaaaatgaaagtggtattaataaagtttggaaagtttggatttgagctaatagtcaataggaattaattttactttaagaacccttaatagcaccactgagagtacacatagcaatttttactgagtaactaaattatccctttaaaaaagtctcttctacagaattcaagctccacgatggcaggccacttctggctcaaacagtgctgttagtattcagcagaatgacggtgttaaaacaaaaatggactgattgagtaactataaaagaagtggcagtctacggccataccaccctgaacgtgcctgatctcatctaaaagaagtgacaaagaagaagtgttgtgcaagaactttatggcaaaaatctggaagtcactttcgagtacagtgatcagtgcttatgtagctagcaatttttttctaaaataagcatcttaaaattaaacagattccacccagatgtggactagagatttgaccttggaagtgagaaggaaaaaaatagatctaggagaaatttcaaacaaacactataatttgttgacagagtctaaacagggtaaaaagaagagaagtcggtgtcaacttccaagtctggatctctgaaagacaaagataatgttgacatagaaaggaggaaataaaatagacactgagcataacagagaaacataaggtaggttttaagcctgagacctatggacaaaaggagatttgaccttggaaatgagaaggaaaaacatagatctaggagaaatttcaaacaaacactgtaatttgttgacagagtctaaacaggggaaaaaagaagagaagtctaaaaagaagtttaacttcttttctctaaacttctaaaaagaaggttttattattctaaaaagaagtttagagaaaagaaaatggtttaaatataaataacatgatttggcatgataggaaacattcaatgaatagtgaccattttaaacatgatacatttggggttttagatagcttaatttcacaatttgggttttggattgctttctgatcccagttttggattgttttagttcacatttttgaacacgtaaaagggcagagattaagaaagcagtgaggaaagcacgaatgcagcttttctagcaggagatatgtgaatgatgagaatgtcaagggaatagtgcctgggagaaagtccaaaatggggcaacttgaacagaaggaagatgagataaagaagacaaagaaacaaaaagattcaaagcaatgtggtttcccagagtgcaggggaggggaagatataaaatgaggacatatcattagcaatcaccaatctatgcctgcgctatacataaaaaatatataaaataataagagaggtggaaacaggtaatttgacggccttctttggagacatgtacgttataatcctatggtagtgactccctctactcattgccagtcttcttgccatcttctatacatattcttcttttgtatttcgaatgtaattatttcgtgctttttattgtcagttcttaacaataaataggcagtgtaaccaagtgttcgataaattgccatttgattggacattttagcatggggaaaatgttttgttgaagaaaggacagcactacagtgataagctgcctgctgatgtaaacactttaagggtttatgacaggctcactatctaccaatactattttcaattcaattcaatttgagtagatgaggattttagagaaagcagctgccaggagaaacatatgacatttaatcttatctgagaacatgaaatcttctgcagaagctataagtacatacgtgtgtgtaatttgagtcttagtgtatattcaaaaaggttatagaggaagctgtattctataggatttaagccaacagacaaaagaaaatacatttcttggtatttttcccaagatacacttgactgaacaaataacatagagagtctaaaattccaagtgaaaacattcaactgattgcaatttttgaactattttttttttcaaaatggtaaccttaattcctcttctaaaatcccacaaaaacctacaattagtgtggatgctatttgattggttgaaaactagtccctgttaacaggattcaaaacactgccaaaatacagaaccctgcggattaccttatggactcaatatattactttaaaaaatgattttaaagaaaaacaacagaataattgaaaattgactaattctgattttatatgcaaggcactcaaaattacacaaaactgagttgtggtaaagaaaaaaatatttagtgaatttggtcatgaccatgacaaatagtaaaaataaagattactctaaaatttgcccaagcacattgtaatataaaatccatttaactttcaaatttatataataaactgattatatatttaaattggatgcatcatttacaaataatttggcttttatttctaatgaatgtgccttttatttcaactatcaaaattcatttccacattatttagcagatttgtttactcaaaatcataatctaccagatactcatgctgtgtatctttacttttgcttttatccacacaaattgatttttacccaattttcactattttgagcccaaatattcttctccatacttgtctagatgcagtcattagccatttaaaaactggtttgctcttttagtccagaccagagagaaagctatgactcttccttgaagtccaattgggtagaaaccttgtagcagccccaaagaaggttgcacattacaagcacaatcacatgccataaactgcaaacatctcattttccattgtcttctgttcccaattcaacttgaaatgagtcctctcctttccacttccaccgccacatgtcaaacccccaatatttcttgcctggatttcctcaacaaacttgttattttattttttcttatccacatcccctgcaactcttcagactctccactggcagagaaatttcccaaaatataatggtactgagaacatattcatgctcaaaaaggttaaatatactcgaatccctagcaaatgaagtacaaacatggcataaatcccttcataaaatgactcccaattatctgactatccttgttttatagtaatcatataatttttcgcccacactggaaaatactttttcagtggaaaaggtgtgttattaacaaggaaaaaaggaatatgtggcctcccagttctccttgtggctatcttaaacttaaaacaggtttttggtcacaggttttacaaacaatgcccaactttcccttctctgaaagtgtaaacccactatttctattgtctaggaggctgtttgcatctgttcctttccctcttttaggcctttttaaattcccacttccttcatggacagtttcttcatccgttcaccatccctggtcccaagacgtcatactgtgaacttcacctccattatcttactctgccttgaccagtcacttctgtgcttggtattatccccctgacttgacccttaaaaatctgatgacttcttattcatttttgcatttttctgaataccaaacaaaggtttttgcataaagcaaacatttaataaatacttttgatgaaatgccatcatcagctataagctgacacttaaattgtggccattgaaaagtatttatttagcaattgtattaaacctaaagaagaggacgttcaaaaaggatttttgtcaaccaaagattttgagtcattttacaaattcaaaatcattcatccattcctgcatcaaagattttctttaaaaatttattatatatcaaaagcccctaatatgaaaatgtacctttatgttgtcttagaaaagtttttcttgagactttcatttaaattcttctgtatgcgatgatttatacttgaataatcttacatctcctgatcccattgtatagaattaatgagtttgaatgtttttttgttttgtttttcctgttgtgtaaagaatgtactcatatctcttgagttaccaattttagatagtatctattggctactcacagaaaaagatgagtgatttagtgtttgcacaagtcccctctctattgtcccttttcacagacctctcaattttttttttttttttgaaacagagtctcactctgtcacccaggctggagtgcagtgcgcataatctcagctcgctgcagcctccatctcccaggttcaagttattctcctgcctcaggcttcagagtaggtgggattacaggcacctgcaatcatgccaggctaatttttgtatttttagtggagatgcggtatcgccaggttggccaggctggtctagaactcttggcctcagcgatctgcccacctcgacctcccgaagtgctggcattacaggcatgagccaccatgcccggccagacccctcaatttttaaaatttatattactatttttgatttacagggtttgtataatatttacattactcacattagtagataatatttgtttgtataatatttacattacttacattagtagataaattaatacttctctattttgtttctagattccttctaacaacgtaatatcaattcaaaaagcaattactatattatggctactaaatattattcccttcagattcattcaggtagcataactggacttgcagaaaaggagtaagcataattattaaaatcctggtttttaaaggattatggatatatatgaatatattgtgaatatattaaccaccagggtctaatatatcctttctcgagttaaacaaaaagttaaaaaaaatccttctggatcatatgtgattgccactgccttactgtctcatatctgacatgcctttttttggataattcatatgtagatatgtaggcatcagattttctgggccatttacatttttagcctaacattgattgatagtttggttggctatagaattttaagtttaaaacacggttccttcaagaaagactttgctcaattctgtttagaattcaaggaggcacatgagatctgatgttcattctttgtaggtatctttttttcccttctaaaagttcctagaattttctgtcaattagtgaaaatttactaagatgtttggccctttccattttttcaattttaagaattttctttcttcagttgtgaaatcttccttctgttttgtttttgtatttaggttatttccattctttgtctctgtttcctcttctaggatgtttattagatatatattgggatcttgcatttatgctcaacatgtcttaatttttcctcatattttcctttttttcacttttctttctggttctgacttttattttgccctctagatctctgctctggttctatgtttcagcacatctgttcagctttttattttcacattcataattttagtttctgggatcatatgcttattccctgactgatattttccatagccacttgcatgtgtgtgtatgggtctgtgttcaatattttcttgattcactcttaaaatgctagttaaaattgttttttaagaacattttcttatatttcctgaattacctgtgggattttttttttgagtcagttaatgctgttttgtttcttttttagtgttttaaaattctgctctgggttttctgcagttaatcctgccatccttagctgttgatgtagaattataatgggaggaccaggttgcatgacaaagattactggtggggtctgttttctttgtttgagagggctgactatgaacttgtgagtttagtgattgttttacctggctcgcttctcttaaagatgcatggatattggcaagcaagcagcctggaacttaccccaggagaaacctgttctaagagttgagaaacttatattcttatcctaggtagagctgtatttcctattccccctggccatatctgaaataaaatcacttccaatcctgccctttctctttcagtgccttataggtacagaagtcctctgtcctcacataattcccatttttcagagttctttcttttaactggaactctttctacattaaggttggagcagaaaggggaagtgaggagcccagctggcccatatctcctgaaatgcagttctttaaatatttccctaatggtcactctgatgcctgcttcaggactttatgttgactttaggtttggaaattatttgggacttttatagtaagaaccacttatgcatcttgggttgtgcttcccttctttgaatttctccataaatcagacccaactggcttttactttctgagagtttctcagttttaccaaatgtttgttctaacaatataatggcttcctctcattctctctccctctctttctcctttccttctagtcttctttcttttttaaaatctcattatttttgtcatttacttgttaccttagatggaggacatacatgtgtctttgtgccagccattatcttgaaccagaaaccagattaaatttctttttacatatttcttttaattattcaaataaatctgtttcgaatttattttagatagcccggaatatatattaatacttggttaaatattttttccacactttaaggtaggtggtactaacccatatgataccacatttagatttttcttttacatttctcaacataaaaaatatatatatatgtggttacagccaaaaggaactgtttgcttgcaatctgttcttcctggcaccctgtatgttccatgagagataagcatctactgaagcataaaaagtgtcttacaaaatcatagtaagtaaatcagtcactacattctgtattatcaatagtcctgggtgtcattaaggttctgtctgtatagaaaagattaggtttgtgtatatgatattctcctaaagcattttaacataaagtcatggtcactgaaatctgaaaatattcacatttcagtcttaatcaaatctagtacctcaggatttttcaatcatattcagaaagttcaaccatttcgatgtgttagctctagctctaagttcccaggctgaatatccagtggtctagttgcataaattattgtaatttgggcagagaattcaaactgtttgtaaactcaatttcaattgaaaaataccacaatgtcactaataatcaacacttaaattaagtaatcttcagccccacagcttcctcagaacccccaaaagtaggatgtgtaatctaaaaagattcattgagcaaatatttatttgtgctatcaaagaagatggcttcccccaaaagaattcctccaaatgttaaagttggtaattttctgcaggattaatatgtagcacaatcagaaaaaacaaaaacaaaaacttatataaggcagcattccctaggagagccacttggcagtcctgcctgcatgtgccctacatgagaattccatgcttcctctgaatcttcacaagcatatcatttaaattaagagcataaatgaggccacataaatgctttcttttccagtttttttaaaatttacttcccccttccagagcagattgcaacagtctggtataattgatcttgtccacaaaaaatcgaccgtaatacattaaatagttctgtaatgtggcaccgttaaaaaggatctgcttcaaatgactgtgaactgacaaggaaagaaaatgttatatagttggctgggcgcggtggctcacgcctgtaatcccagcactttgggaggccgaggcgggtggatcatttgaggtcaggagtttgagaccagcctggccaatatggtgaaaccccatctctactaaaaatacaaaattagctgggcatagtggtgcacatctgtaatcctagctacttgagaggctgaggcaagagaatcgcttgaacctgggaggcagatgttgcagtgagccaagatggcgccactgcactccagcctgggcaacagagcgagacttcatctcaaaaagaaaagaaaagaaaagaaaatggtatatagtttaccaacaggtagcctaagatagttatatgcagtgattaacgattacaaacatacaatgtggatactgataatcatttttactgccctcctttaaggaaatggagaaatgtcaggagacaaggtacagctgaaaattttcctccagtttgatctattctgcaaatctcttccatccttgtccaggttattgacactatttccgcaggattttcaggctgttcttttctcatctggactattccttagagcaggaattttattactaatctccaaactacctctcgaatattagaattattcacattccaaattataatacaaagatttcagcaactgctctctgatgatattttttttcttccagtattgtctgttaaatatttgaaggcaggtacacactgcctcaggaacaactctgtcctctctccaaatgctccagattcttctctccctcacagccctctttaactgctgtaatctgtaagatctactcttcgggcaagcctctatgtttaagaaaacactttcaggccgggtgcagtggctcatgcctgtaatccagcattttgggaggctaaggcgggcggatcatgaggtcaagagattgagaccatcctggccaacatggtgaaaccccgtctctattaaaaatacaaaaattagctgggagtggtggcgtgtgcctgtagtcccagttacttgggaggctgaggcagaagaatcacttgaaccctgaaggcagaggttgcagtgagccgaggtagtgccactgtactccagcctggtgacagagcagagcaagactccatctcaaaaaacaacgacaacaacaacaacaacaaaataagaaaacactttcagttgggggtctgctcagatatggtctaaatggcaggtgaaattgagacaattacttggataaatcaaatcacatcctcctacgcaattcattcgaatatattcagtcattaaacaaatattttttaaagaacctattacagactcaatattatgctgagtgctgaagagaaaatggtgagcaaaatcaaataaagtccttgccctcatgggtaacagcctaatggtgatgatagccaacatttattcactgcctattatgtgcatgaaacacttttcatgactcctgtcatctaactttcagcaaaataaatatgagttattagtacaaaaaaacacaccatacagagacaaaagaagttgtgtgtgtgtgtgtgtgtgtgtgtgtgtgtgtttgtatttattttaaataatcaacccttttcctgcttttccccagaatatatgaactcaagtcttctctagttcgagaacagggctgggggtgatggcagggggttgctttacattgctttgtattggaatttgtattgtccagggggaactcattaccacctatagatacatagccacttgcccatgttttctcagctatttagcagacacaggatttgaacccaagatttcacattcaggagcttatgctctttcttactccactggcacacctgtgtacccctacactcttctgcccctaaggtagataaatagagaaaaagaacaagaggggtgatatggcaaaagtatctcaatagttgcatcaattctcctttgctttgtgaattctggatgaaacaaaggacaactataataattcttgcttgctcttctctttaaacatgtagtagtcctatttgagaataagtgataatgacaactttttagaaaaaaatctacatgacccatcattaaatgggaaaccatttttttcagaaaaaaaaaattgttataatggagattacaataagatgcctacagaagattcccattgtgctatagtctaacttaaatcacaaatacgcatttatattattatatcattaatattagctcattgaataggcatttattgagaatggactataagaagagctatatgttaagagacatattcattcagacagacattgcttattgtccacaacaacgatgacttttaaaagtaagaagaggaagtaaagtaaaggggcaggagtgagtagagggaggagtctaaggtgacaaccagctttctgacttaagctgctatgcatcctgaggccactggaagaaaatctggtttgagatttattggaggttttttcttttcttttctttttttgcctttttgagttttattttcttttccactttgagggtgttttgttttgtttccatcggatgctctagaagaggcagagtgctcattggaggttgacagtgtcataacccttgtctgattatctcgattttatgagcccaattaaggatgataaaatatgtgttttagagatttctgccatccttacagccccttaccatccctaaggatacttctcctgactattaatcacattttaatttttttctcttttcagtacaattatgtgagtttgtgttattgcatggccatgcctcagtggtctacccttccttcacaccacttttctatagggaaaccaaaggtgcatttataccataatttagttgaattcagcagtagttacaaatgatgttattaaaatctattgggaaaaatgattcatcttgattcattcaaaatgattcattcaaaaacagaggacaaaggaatgtggggaagttaaatgatatatcattgaataaaggcacttcagaaagctctctgtcttcataactgctacaagtgtcctttataacttcattttacccaaatgttttccaaaacatctgtctaaacttttcaactaagtttagttgttattcttgcttcttgtaatttcagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccgggtgagtatgttctctatgagcccactgcatgtcttccacctgtgggtataaaaaattaatgagccttccatttttcccccatttataatatcctaatcctagccacgggtttgtaatgaatcacagaatgctgacagtacaaatacagtttaccataataagagtctcgttttttttcccctgatattgactttatgaaagtgttaagtgactggatccaatatatcattcacctcatcaacttgatgagtgtcattagtttccatttacctcctcattgctgaccaatgtgacatctggagagagatttattggtcaaaacagttttaaaactaaaaaaaataaaatacaaaaaaataagaagaagccccgtagaaagatgctttagagttaatcacaaatataaatgccagaatccctgaaacactgggctaggatataaacatatataaaagatgatccatgtctttctaccatacttagggaaattcaaatcacactgcatcaattttgaaaggaaatggcaaaatgagttaatctctgactttcctcatgtgttcatggagataactatattaatgtgttttgcccctgtttaggcttgaaatatcctttttttcttcagtcttgcatttccatgttgtgcaaaacaccatgctgaatgagataacttgatggtaatgttttttttactgaacgaaagtggccctatggtgatttaaagcagggaaattagtacaaatgagattttccccactttgcttagtatcgcttcagggccttaaaatccaaccttatgctttcaggttaaatcatagaataactctatcgagatacaagcagttcgtgaaagagacagcaccaatcattgatctcttacctttaatttgcttttcttattagacacagtaattttagcagaatgctaataggacaaaactgaaaattacagatgacgggagaccacttactatgaaaagcagctactataaaaggtaagctctatgaagtgagtaattttttcactggtgtgaacaaacagtgactggcatacaatttgccctcgatacatatttgttgaattcatgagggagaaaggatgggaaaggcactagagcagagccctgaggaataaggagacagcttggaagtactgggatatggaaatagagggtactcaagaggcacagcaaagggagatgaaggaatgtttcagaaaaaaagaacaacttattttcataagttcgcctttactaataatccaaaagaattactatactgtgtggtagtcagtctccaccgtggcccccaataacctcacttctgaaaattgatgtactcctgtggcccgctgccactttgaatagggctagtctgtgtaaacaatagtatattccagaaatgatgatacgtctcttctgaggccaggtcataaaaggcattttggtttcggccttgctctctgctggataattcactcgagtggaagcactccagtgtcactgatgcaggacagacgagccccaaagtgggaccaagcctgccagaattcttggctccacccaggaaagaattcaagggcaagctgatggtggttagaagaaaacagctttattgaagcagcaattatagctccatgactgttcctgcagagcaggagcagcaggcagagagcagcagctcagggcagttctgcaattgtgtttatacctactttcaattgcatgcagagtaaggggtggattatgcagaaatttctaggaaaaaggtaataactactaggttgcaggtcgctgccatggaaagaggctgtaactgccatggcaatggtgggcatgtcttacgggaagctgcttctgtcctgtccctgttttagctagtcctcagtttggtccagtgtccaagtcccacctccagagccaagtccctcctacctcatcatgaaaactctcagcagccctgtggaaagaatggaggcctcctgtccacaacaagcaccaacttcccatgcgtgtgaaggagccacctagaaagtcatcatctggctccagtcaagccttcaggtgacatctgaatgacatcttgaatacaaactcatgagagaccctgagccaggaaaacacagctaacctgttcctgaatttctgatttacggaaatgttgtgagatgatgtttattgttttaaactgctacattttggagttatttgttctgcaacaacagaaaatgaatgcagctcaaattaaacttagctacttggtggccactttcattttaatatcagtgtagttatctatccagaaggcacacccagggacagcgactgtatacttccaaagcagcccgaagtatgtagctttagcaatattccttcatcattcttatggtggcttactctttgacaatcaggtgactgaaatcgttctcatgaacaattacttaagaatgctttcctttcttgaatctagggtgaatggttgaggccagagaactgtagtcttcaagctctatccttttagagggctgtcgaatctcctcagagtagagactttgtgtctttaatttcagatatcctcccttgagaaagtagatgctacttcatctgtcatatgtcatcagggcatttgagactattagatctatcctgtcagctcactacaaaggaaatgtaatctattataaccctctagtttcttattgggttttaatgacttaaaaatattatattttatttacttataagattacaggaagaaagaaataaaggtaaatggaagcacacagtgatttctttcaaaaatactgagaaaaaaaatgaaatgctccactgggtgcttcaggaattaactttacaacctaagggactcataagataagaaaatacatttttgaaggttatatttaaaagctaattactatagaaacaaaattgcattttgttgggaacttccatagatttacagtgttcctgctcaaaaaacacaaaacaaaacaaaacaaaacaaaaaatgaaaaacagcaaaaaaaaattggaaacattaaacttcaagaaaccttaaaggtcagtttctctaaccacatgtcggaagctttaattctcaatatgctttacttctcagaacaacataagatgtgttaaaaaagaaatgtacctatactcggtaggtttcattacataggataactatttatcattataagctaaatgtgaaattttccttgacaattttttaatgttttgaaccaatgaaaaaacgtttttcataaattaaaaataaagttgtaagaatatgaaaaataccagttttttaacagctatgaattttctttaagtaaaaaaataagcaatatgtgtaacatttttattataaaggagactgtaatgttatagtttacagattatgttttaataaatatgttaaatatgcatgctaaatatgcatgacttaattttcatcaaggaatctttgttaaactatgctgtgaattgatttcatagctaaagtctgaaaaccaactagtatccacttcaagaaaggacaaataacaaatgcttgaacaaggatcttacaaatacagtaatatttgagactaacaacttattttacatagttgctaaatgatgattaaaaccaacactatttggaccggacgtggtggctcaagcttgtaatcctagcactttgggaggccaaggcaggcggatcacaaggtcaggagatcgagaccatcctggccaacacggtaaaaccctgtctcttctaaaaatacaaaaaaattagccgggcatggtggcaggtgcctgtagtcctagctacttgggaggctgaggcaggagaatgctgtgaacccgggaggcggagcttgcagtaagccgagatcacgccaccgcactccagcctgggtgacagagcgagactccgtcaaaaaaaacaaacaaacaaacaaacaaaaaaaacactatttgaaagtgaaaactgcctaatttccacaactgttacaaagcataaacaaagattattcaaccctgtttattgctatattaacaaattataccatctttcattataagtataaagagatgccttaaccatatatttttaaaatttgccttcctcacctttggtattattctgttattaagacgttttcagtctgaaatacatggtataacaaatggaggatagttatatagatagatcttccagggacaaaaaaatggcccattcttatcttgacaatgtttaccaatagtgatttattcaataggtttcaatccagtgcatttcagaaaatgtaagtcatcagctggtttctgctgtcaaatcctgttattattgcagacaagtacacaaagaatcgtgaaaccaaagtttccgggtgagtgtgcttacatttttaaattttcaatcttttcagaaaagtcaactaggagtactgttttataaactctttaaaaagaatataatttttagagaataattttcttctgtatagttttaataactcctgaagaaaggattacaagaatgattacaagaatgttgaacaagtaaaatccccattataattaataattttcagtcttcattacagaactctcaatctaatatctctaatacaatgtttttcctaaatatcaagtggtatttttttaatgtgcttaccatatacaggatgtgggaaaattttaaatacattgtttacagataactgatacttagtcataccattcttaacacatttcctcttgctctacatgtaataattttgttaattattattaattaataattattttgttgactagtttgacacctcgatattcaaaactcaatatttctgacttaagtaatggaagactgcatgtgcaattacttccagagacactaatgattatttttaaaccattactcattaaatttcatataaatgcatacaatctgcatgggtacttaaaattttaaactttagtgccatattttgcatatcacatgattcacacatgaatgagtacatgttgcacagttaatctgataacagaatataaaattatgtaattatatgcattatatgtgtctctctatatatatatttcttaatattctgcatttcctttgagtcatgtacagctttaagtgaccacaaagaaaacaatatttatctcttcttcaaagtggcccgtgtcctttgaaaaatctaatatgcttgagatgattcccaagctgaaatcctgtttttttgtgatgttccagatctatataacctttaaaagtgcgaagacttctcctattttaaagacaatttaaaataaaattaaggaaaaaatttcatttacattaacaccaaaaataaaatacttagtgataaacttagtaaaagaagcacatgacttatccaggaaaaactacaaaacatcattgaaaaaaagtgaaaaaaaaagtataaatagttgaaaagaaatcctgtgtttatgaatcagatgatttactattgctaagatagcaatatttcccacattgatctgcatacatattcaacacaatcccagtcaaaatctcagctggctccttcactgaaattgatcatctgatcctaaaatttatatggaaatataagggacccagaatagccaaaattttgaaagcaaagaataaagatggagtattcacatttcctcattttaaaacttattacaaagaatgtcataatcaagacaacatagtacaggcataataataaacaaattagtggcatagactagagagtccagaaataaacctcatacacatttataatataaacgtgtatgttcacgttatttttgacaagatacaaagaaaattcaataaagaattttttttttcaaaaaatgatgccaaaataactggatatccatatgcaaaataatgaagttatacacctacctcacactgtatataaaaattaactcaaaaaggatccaagacacaatgcaacaactaaaacttaaaaactcatagaagaaaacaggagtaaatctctgtgaccttgtgttaggcagtgttttttagacatgacaccaaaagcagaagcaacaacaacaaaaaaaataaattgcacttcatctatgttaaataattgtgtgggtcaagagacaccaccaagattgttagaagacaacccacaggataggcaaaaatatgttcaagtcattattatctctaataagggatttgtatccagaatatattttttaaaaactgttaaaattcaacagttaaaagaccaataatccaattacaaatgagccaataaattgaatagacatgtcccaaagaagatatacaaattgtcaatagtgcatgaaaatatacctaacattattagctatcagggaaatctaaatcaaaaccagtgcaccaactaggactattataataaaaaataaagacaatagcaagtgttgataaagatgtggatgaagacatttggaattctttgcattgctgtggcaatgtaaaatggtactgtagctttggaaaatttgacaattccttagaaagctaaacatagggttttgatatgacctagcaattccacttctaggtatataccaaagatagttaaaaacatatgttcccacaaaaatttgtgtataaatgttcataacaggattattcataataccccccaaaaccagaaacaacccaaatgaccagtaactgatgaaaggataaaaaatgtggtatatctatattacttagcaatcaaaaggaatagtgtattgacacctactacaaaatggatggaccttgaaaacattacactaagaaatgaaagcagctaatcacaaaatactaatattgcatgtttttattttatatataacatccagaataggcaaatccattgaattccaggagctagggggaaggaaatagagaatgaccactaaagggtatgggatttcttggatgatgatgaaaatgaactaaacttagatattggtgatggatgtgcaacactgtgaatatacgaagaaccactgaattgcatactttgaaagagatcatttttggcgtgtaagttatctctataaagctgttatttaaaaaatgtggagactatttaagtagatattttcaagtggttttaagactcagtcctataatgctgtacaaaaacatagtccatgcccattttgtttaaggcacaaagttcaatgtgagaattcaacaagaccaagacatggttcttgccctccagacacaacgtagatggggagagaaaaaaacaaaggccaatcacagctcacagtgagtctcccttacagaaggatgaggaaatggaactgctagaggagcacacagcaggaccacgaagcccagggttcatggatgtgcagacagcagtctggaggttgcacaggagacaaggcacagaagaggagctcaacagcacatcaggcaaaaaacaaaattactaatatatagtttcaaaaagccttgacaaactggaggaactaaaagtattaagaatagcaggaaggtagataaaagcagtggatggagtagcaagaaacaggccaggaaagagggtacatgtgagatcatgaagggccttgtgagccattgagaggagtttggatgccatcctgaaggtagttgggatcttccatagggatatagccaggataaagatgatgagtcacgttttagaatctctggactgtagcgtagaaagaagactgcaggagtccaagactagagagaagtcaatcacgctgaggctgttgcggaattccagatgaaagatgatgacaggaatctgaggaatggcaatggccatgggaaaaatgtgagtattctatcagctgcttcttcaaggaccatctaaatttgttagatacagattatcaggtacaaaggtacatacaagaaagattcctggagctaagagctacttgagatcgtagcattctaatcactaaatacttcgttagtgctaaggaattctgttatgggttgaattgtgtacctcccaaaattcatatgttgaagtcttatccctcaatatctcagaatgtgactgtatttggagacagaatctttaaagaggtaattaaagtaaaataagattactagggtgggacattatccaatataactgatgtttttacaagaagacagaattaggacacaggcatgaatagagggaaggccatggaatggcacaaggagaaaaccatctaaaagtcaaggagagaggcctcagagaaaaacaactatgccaacatcttggacttctggcctccagaactatgagaaaataaatttctgttatttaagccacccagtctgtggtactttgttatggcaaccctagaaaactaatttaggctctaaagggtcggcatttgtattactaaagcatagtcaaaagatacctcatttgtcagctaataaacgtggatttttactagggactgtacatacagaaaggaataaaacagtttcttctttcatagaatcacagtccagggaacagaaagtcaattaatcagtaatgattataaaaattacaagtgatgttaaagagtcatgcaaaggatactaggggaacatagagctggggcacttcagcatcagcacaggggtaaaaagtttctcaggggaggtgagactgccttgaaagataaaatggaactggagaagacaaagaaaggcatttcaggttggatgaatcctataagcaaatgtacactgtaatcactgtaagcaatatggcatgattagaacatggtgtgtatcaatacaagacagtcagtgaccatataacgaagggctttgtaagcagcatctagtttccagactttattctttaaagctgtggtgagtaattaaaggacttttaggcaaatatatgacatgatagtattattttttaattttagagaaatcactgtggtgacagatcagagggaggatggcagagaagcaagaatatgaattagagaaatattgccataatgtcaggcaaagcaagactttgtgaattatgtctaagtggtggtgatgaagaagataggatagatttgagatacagtaaagacaacagagatcatggtagagtaagggcaaaagatgaatgaaaagatgggatctagttttctgatttgacatccatccttagtgtttcacttctttccactgcatacataaatccaataaaccagcctacatggacatctatgcatgatcttgtccctgtctaactcccaggcaatgcgcaaccatcatttagcaatcctccttagtccttttagtgttcttccatggacttttacagtacatgattatgtatttgtttgattttatttttattttaaaaagtgggctttaaattttaggttatattcctaagaatcacttaagggtttacttaaaatgcatatttctcgttcttagagattacaactcataggtttgagaaagaaccctatgttggcatgtttaaaagaatccctccttcctctagtgattctgacacatgcaagtaatgaactgtactttgctaagccactaattaaaagtttattttcctaagaagagtagaagtcaggtctgattttccaccactgtgttccagatcctaacatcatgactaagacctaataggcatcaataactatttttgaatgaatgaagaaagactaaaatgccatgtgaataggtagtggtatccttcactgaaaaggggcgtacaagggaatgactggttttgaaaggccgatcatgacttagttcatgggtttgtgagccaagtgtgcctagaggtaaagatttcaaaggcacaggtatatgcaaggcaattgaggtcatgaatatttatgagagagctctctcccacagacatgatgaaaaatacaaagagaagatggcacaaatggatcactggaaagagtcaatttaagaagcacactcaggaagaccagtggaaaacgatgtaaaaacatgatcaaatggtaactagggaagaatctagtccacagtgcaagaggccaatcaaatagttaatttcaggaatgatgaagtagttggcaatgtatgaagacagtaatatttcataaccataggatttgaaaatttaggggccttggttaccttcatgagataagttttctgtgaagtctctcttatctactttgctccagacaggtagatatgttcctcctctgtatttcatcctcctccaagacatatttttattgtaacactttggcattatatggtgattatctgttgatgtgtttatttccccaccagactgacagcacattaatctcaaggaccacccaacccctatataagacttaggacttagtaggagttccatgtttgataaatatataacttgattaataaatagaacatgtgataaactagtctatgactagaaatgtataacttctctctatttagtgttttgagtaggcctggctttaggcagtaggcagatgggagtactaaacttatcgtttcctaaatctgtgtggtctctagattatgtcatccgcagcttcagagaagctaattttgaggagactaagtaccctgaccgcatacctcacaaggatgtttggaagacctaacaaattaatattttgaaagtttatttattattattattattattttgagacagagtctcactctgttgcccaggctggaatgaggtgacacgatctcagctcactgcaacctccgcctcccgggttcagacgattctcctgcctcagcctcccgagtagctgggactaaggtgcacgccaccacgccctgctaatttttgtatttttagtagagacggggtttcaccatattggtcaggctggtctcaaactcctgacctcatgatccgcccgcctcggcctcccaaagtgctgggattacagacatgagccaccgcacctggccttcaaagtattttatgaacagatgatgtggaagacagaaactctgcaggttcctttattaggactgagaggagcactggagaaaagatatccacgctctacccatcattaaatacagctggtctgtctaaaaattatatcagaagcaaaaagtcaaaagccaccatctctggatttcatccagatctgctattacttgtttttatcgtccgacaatctcagctcttaataatggtttctgatatttgttacatgaagtgccccatctttcactcaagttctatgcagaaaaagccacgtaaaagagtgccttctccccttaactctgagtccacggatggtggcatcttgagtgtgcatgttggcgtatgtattgtggatgcggtggtttaagggaagggtgcaggaagtcagacctgtaatattttgggtaaatgggatgtaataaccttattataaggcttcaccccaacacagtgcatatgcaaatatgcagggcacatatggtatttgttgcaagactattgaagtagaataatcttttcccttaaattttaacttatgataattctaatttggatatcacagagtgaccatttttaattgaagccattgagttatgtttttgttactatgttcatgtttatattatagatggccaaatttagagtttcaaataatttccttcaaaaaaatattttcaggtaggattacttcatctgaatgtttaccataaaaattactattttagctattttaatgtgatatttttgtgaatagtatttaaaagtactatagtattcatgtttttaaacttaaaagtcagctaaattttaaaatatgacttaaatgttatacataaataattacattgaatctatatggtcagtactttataataactaaatctaattaaattgatccttcattgctaataagtagaagttaataatactaaaatgagctcagaactagtactccctaatggcaattctgcaaattttcagaatatttcatttaattatgtacatttcttttttccatgtactaatttgattcctgcatgcagaaactaagataattcattttaaattattctgtgatattttgaacaacataggagatgttctgttcagtgcaaaacacttacccatttcagtgttagcccatatgactcaacgttcatttaatgcaatctatagagggttacaggaacacgtgtcttcagaatgttaaagatagccaaagaggtttggaatgaatattttcagtggcaagctattttatattagtaaacaaacaaaacataaagatgataataatagtaataataataacatttattgaggacatactatgtgtcagattgttctaatcacttaacatttagtgcttataacaaccccgtgagttaagtattttcctcatattttgtttaaagaaatacagaacagtagttgatatgcatcacatcacacagctattaaatgatgtccaatagattcgagtccagggtgactactgaatcacattttactgtctctcctcaatgctcccggggcagtgcatgaccaataataggtagccaaaatgttttgaaaaccaactctattaggaacatcccatccagaaaagggagcagaggagataggagacagtgaagtcagcataaggcatttaaaataatcgtccaagtgaagggaatatggccctagtcaggggaggccttagacaggagcaggggatgaatgagtcaggccaggcaatcagttcactgagaatagaaaagaaagggtaagtttaaaacagatttagaaagaagcagcaaaataatttggtagtaatttatttaaaggattggttctcacaggacacttagaataaggtaaatgtttgtttcatggtttgagaatgctacatcctagtgattccttttccctcataatcattacagtaagatactctctccagctaggattattctagtcattacattccatatgaggcatcataatcattttggtatgaatttagcatgttttagtcaaagtaaccctaaatggaactcttgctacaaagtaaatcaaggggttttttggatgcaaggcacctggcacagttggtactgggataccatcgtgaaattagttttaccaagtaaaaatctgaatcctgagttttgagttttccagttcttttttcccacctaggtcatggaatactattagccagccttacacaattaacaagggatctgaagattcatctttgggaatttttagatttagcaacataaaagatcaaaatgttatgatattaggtgatttttcaatgaagttctctgtcaacagactcatccaagtgcaaagagttttaaatcagcgttatagtgcacccttacatataaatggaagtccaaagatcactgggcatttaaagaaattttctgccatgcaaaatcaacattaaacaaatagagagaaaagtaatttggggaaaatagtctttttccccaatgcatggagagggaggcatctaaagttattataactccagagatttttttaaaaatagatgcatgaaataggaaatttctattaaaaaattcagaaagcataaaagaataaattaactataattattatgtttaataatatatctgatacattatcattcattattattcataataaattataattctggataataattataattgattataatctcagaaatgaagactcaatagaataatttgaaggtaaagctgagataatctcccagaaatttaagcaaaaagacatacagaaataaatgaagcaaaaaagttaattaaagataatttcagcatgcccaataattataagaagaattcatggaaaagcaaatagggagttggaatcattaaacaaaaatatcaaaatttttccagaatgaaagtatatgaaattctagattaaaacattctactgagattccagcacaacatataaaaatatacaaacattagtttatatcttgcagaaatgtcagaatcccgagaacaaatagatcataaaagattctggagaacgaaagaaacaaaatgaaaaaaaaaacctagttgatgtgctgaacctaaataagaaaataagtgaaggaagagggggagttggctacaggaaataggagatacgccacaaaaaagatgtgaatccaccacaaaaagatgcgaagaatatcctcagaacggcagtcaagggagatcctaggatgcaagctgtgctgtccacctagacaggtaccagtctaaattggagaagccggagagactctctaagaacatgaactttaacatcacacactggggcctgtcgtggggtggagggatgaggagggatagcattaggagaaatgcctaatgtagatggcgagttgatgggtgaagcaaaccaacatggcacatgtatacatatgtaacaaacctgcacattgtgcacatgtaacctagaacttaaagtataataataaaaaaaaaaaggacataaactggttaactatccaaatatcctctggtagaaagtttgggagaaatcgtccttaagtatataaaaaacaaactttaattatataaaaaccaaaacagaaacactaagtatttaaacagataactttaaaaattacggttactagctataaggacaacaaaaaaaatttccaagaaaataaaagtaatcaaagcataacaggtgacacagttatgagcagcatctatatgcccatgataatgtaaggtatggtgtagctacattgggaagatgataggagaggaagtgtaaataacagggttaaaatagatataaaggagataattcctcatttcctatggtgagaagtcaatataaacaaacatagcagaaaagtaagaagtagaaagtgtgagcaagttattcaggagagaagagtaaaacacatcaaggacccattaatttaaaaatttgactgtagttgactttgggcatctgaaactaggggcagaagtactaggggctgccatcttcgaaacgagcttagtgggaccaatggactttcaaaatcataagtataaataaatttaataagcattttaaagaagagcaagttgaaatgaaaagttaagaaacctaactgaaaaggaagacagataagaaacaaagtagggagagctaaaagtgaaatgtcaaatttaaatccacatagaaaacaatgaagtacagggtagagtttgtataaaatcaaatcattaatgtagaaaccacataaagcttcttcctcaaaccactgaagaaaacaatacagacatggaaaatataatggaaaatatggaagaaaagagaagacagaggctattgagagaattatagatgattaacatttctgatggggaaatccaaacagctgttatagaaaaataaaatcaaagatatgaggaaagattttttttttctgaagaaacatctgtgcaaatagattgaaagtcaaaatcaatggaaagaactgacaaaacataagattattttggtggggaattacaagttaaagaaaagcccaataaaattcaagcaaggacccccacccctgacaaaatcatctagtaaaaatcttttaaaaagatagtctcaagttttgatgcagccttctcattatcttttacttctaaatggtcctgattgcacttttgacgtgacttactgaaaagttattatttaatttctaaatggttgtagtttatgtttatacatatatttctagttattctgccacaatacaaatgcagaataaaaagaagcgtaatactttttaggagaaactcttatgatcacataattaataatatgacaaggtttattttacatttgaggactagagagaaactctcagatatacaatcattcagaaaatataacatttaaagacactttactgggaaaaattacctgaatatgtaatgcaataaactacaaattcaaacttgagaagtccaataaaggagccataatgtaaaagaaatgactgtgattgctgaaacatgtgagaaacctacaaaaatgtgagtaaagttcattataaaacaggattacattatcaacaatagttatgaaggatatataatgtaaatgtaagaatataataagaataatctagatccaagcacccaggtctcaatgaaaatataacttgcatgttgttttatgggcaacaaagcaaacagcaataaaaaaaaaactgttagaaaaatgacaaattgacaagttccagagtagagtgaaaatgttttttgtttttttgtttttttgtttttttttccgagacggtctccctctgtccccaggctggagtgcagtggagtgatctcggttcactgcaacctctgcctcccgggttcaagcaattctcctgcctcagtcccccgagcaactgggactacaggcacacgccaccacgcctggctaatttttgtatttttagtagagatgggtctcaccatgttggccaggatggtctcaatctcttgacctcatgatccacccgcctcagcctcccaaagtgctgggattacaggcataagccaccgcacccggccgaaaaagtatttttaaaaatgaatcataaatttcttaatagattaaaagtttttttaaagaaaactttgtttaggccacattttctgataactttgtagaaaaactagaaataaataaaattataaacatataatgcaaccacttagaaattaaacaataactctttccaattagtcaggtcaaaagtgcaattaagaccatttagaaataaaagataatgagaaagctgcatcaaaactcaagtgttacacacaaatctgtacttataacaaaaatttgtattattcaatgttttattttaaaatagaaaataataaaaataaatgaacttagtattaattatagagggtaggcacaaatgatacataatactataagaagtagagggaataattaataataaaagacttagaaacagaataatggtgaattaattaaaaagaaaatccaagaacagtttctatggaatagccagttgaaattacagatacctggcaagtctaattgagggagaaaaaaaagagaggaaaaaactcaaatacacagcctggactctgacatacagatgtaattataaatacaaaaaaggaaaataataaaataccatatttattaaataaaataataatataacataatataatattgctgtattgctttttaaacatccctggtctcccatgccttgaaaataccatctgtgacatagttgtattctttaactgctgcattctttttctttcttcaccatacctttagaagcaatgttttatgtcccctgtaccatcttccccatgcaaaatagcttttacaatctattcattttaaaggctcacgagaaaggtatcagcattcaaatctaatggcctcttttctatctacctcttttttgaagccctccttacttgagatctgaacactatcactattatttctctcttgtcatgaatgctggttcactattcttgttgatagttcccctatgactgcccatggttttatccttaatattttttgacttgtctttgtcagaggtcccaactattccttggccttaaacatcattgctgtacttcaatcctgatcttgttacttatgaactagaacatttccaatgtcctgctgaccaagcgctgtgagatagaactaaagtatgagacataaagctcatcatgtctacaaatggattcaccatttggcctaaacattttcttcttgattctccaatttttttcagctcagttttatgccctgtattggcaaccatacgtaatttttttttttatccatccatggttttttctggccctgctggaaccatttatcataatgccattccttgactaccacaaagggaacgtagctagctttctttctcttctaatccatcttgcacatagaaatcggggacagataaaaatactcttaacattctctttgtttacttgtttacttctctaatgaaaatttacaacttctcacaggttacaaagcaaaataaacattagtaacctgactttatgccctcaaacactctttcccaatctaccttttgagcatcacataaaatgcccatatgaaaattatatgcttcactcaatttttgtattcatcttcttttacatgtctctatttactcttgttttgcctctgctttgaagaccattcttccattcctagctgtcaacacactactatttcttcaagaattatttcaaatgcctcgtccgttaatttgtccccgatcacttgaatcataagtggtccatccctcctctcacatcatgcaattttgttggtatcatttgtatgataatttcattatgctcctatattataatgaactcctctattagttttaactattctttaagtcaggaaccatgcctaatatgtaccttaaaaatgccttatactttggctccatattattttacttaagctagcatttgcacaaaaaaggtgctaataatatttttaatgtatgtacaatcttgagataatataatccaactttcaatttttgtaagtattaggaaataatagcataaacataataaagcaaatatgtgctatcattctttgggcacttttgagaattatacaatacaagctaatactccaaaatccatttctatatactttctcttcattgtacaaactttccaggattgaatatccagttaacctaactctgaaatataaaatagaatgtataatggcaaaattcctaagtatttactatgtgttatttgttggccaaagcattttagctaattacatttatttaaaatggttatacatgttattggtctggtttatctttaaataggaaaatctatcttttgtcattataaatttccagtttccaatgataaaatcattctacataacttgaaagccatattgacaaggcactttgaaaattttcatctttaaataaacattaggttttcaaattaggtcaggatttaagtctcttatttataacttactaaatgtatttccctgagcctcaatttccccatctgagaaaataaatcagtaaaaccttacttcaaatgatttttcagtattgaatggatgaatccatataaagaacctagaacagggtaggcataatagtcatagttagcaataatcatcatcatcaacaaccaccaccaatccctcctcctgttcactcacctacttattctgcctaacaccatagctgctgctattcttcttcctaaaataaatgtgatgtatcccctacttcctgcttaaattggatagagattctattttctatttcccattttaacatctctataataaacaacagataaattatttttaaaaaatcccaaatgtactcttctttgtataaaatttattccagaaaatgtacagctctggtgtaccattgctataatttcattaccatgtaactgatacatttcatgtgacatattctgttgggttattttaattaaataagcacaatgttgaagctctaatttttttcacttttaaaatggaatgaaatattaaaatgccagctttgtgaccttgtcttctccaaaacaatattttgtttgaccaaaagtagttctgaaaggtgaattcgtcacatgaatgaataaaactcaatgtaatactctgcttggggtggattataacctgtctccgtctcccaatgcataacatgaaccctctagtacatctaatacatctagttttgaatatattaagaatatcacatggtagtaatctgaacttagactcagatattgaatgcttagaggctaacctaatacccaattgtattgattacaatacaaaatatggtttcactgcactcatctcaagagatttgttaggtgatgatgtttgtaaaaatggatatacagctggaaagcaattcaatgatagcttatcaatcaaaatataagcgtacacttaaacataagaggaaagctgaaggcattttggatttccagtggcagggcagttagtttcattactcaccaaattgcaaaagatacaaaatgggatttgctcccaatgttcatggtactcttttgtactttattttatttttcattttcaatgcctatcttctgcaagtacatatttaataatgtatcattgtttcatatttggaaaaatatattccaatcttttctcaaagaaatgaaatttaaaatgaattaagtgcttcctaaaattgtttaagctattagtttcagtgtaaaggaacagaaaatggcacatctttaattactaaatgtgtaaatacagacataagatttttttaaattgtagataaaaataaaaacaaaaagataagttttagagaaaccaactcaataataaatcaagcaaaagggtaataagggaggccaggtgcagtggctcatgcctgtaatcccagcactttgggaggctgaggtgggcagacagcttgagctaagaagtttgagaccagccaagataacatagcaagacccaatttctacaaataataataataataataataataattagcctgatgtggtagcacatgcctgtagttccagctactcaggaagctgaggtggaaggattgcttgagcccaggaggttgaggctgcagtgagttatgatcgtgccactgcactccagcctgagtgacagaatgaaaccctatttcaaaaaaactaaaattaaaaagagtcacaaggaagaaaagaacaaaaggcaaagcacatggtatataacaaaaactagaaatagtctgcttagaggaagaaatgagatagaaagtatagttaaacaaaattatttttataaaagttttcagaaatagtttttcttaaattttctgtttttgtttccagtctttctttttattgtcatatatgttatttttagggcactaaattacataactttgtttctaatatattactaacatcatatggttaagatttatcattcttaaagaacttcctgttttgtttggcaaataataggataaatgtaagaagaaaagagtaagttggaatttgagattccaatttgtggcacagaaattcctctttttagaatggaaatgatggatgtgttgcctataactcaaaatgaaaatgtgagagcagtaagaataaattatgatgttaaaactcaaagaaacacttaaaaacaaaacaaagaacataaataaaattatttagaacagaaacaccaatagaacaaaacagacgcaatttatctttttgatagattcatagaaagcttaatctggtgcatgtgaataggggagagtaaggtacaatttatagtcgatcccatgacacggtactaagttaggttgcagagtgctcatagctggatgtgaagaagcaaactacgtaaatgatgaaaggagattcctattaattgctcaggccaagagactatcttcatagcctgggctaaggggtaggcagaataaccaacagtgtatggttaaatttatcttgcgtcactaccagacaatgctaagaacagctataaactagaatccctgtcttgtcacacagaaatatgatccaaacataaatcagatccattaattattggaaatgaacaattaccacaaatacctgcatttactatatttgttatatttcatattcttattaatttgtccagttattgtttataattgttcttatatcaaattatttttaaagcaaaacaatttattacgagggtttctgctatttgacacttcagatcagtaaatgaagcacctactagcagtttgttactgttgttcaaactttatagctctgtttagctcagttttctattcagtgtttgtttacttgtacagatgcaaatgctcactttattcttcctaaaatatgtgtggaatacaaatgctctcagattgaatccctctttgaaccacacatttgaatattttctgcttaatatttgctaatgcccatgaaaagaaatttgattgactgtaaaaggacatatcaaggaaaactcatatctcagaatactaaaatgaagtacaatgactatctctacaaagcaccaaaaacatccagttgaaatgtgaacatattcccaactctgaaaaaccaaaagcagcttgagcactttcttacccttacttccccaaataataaattatcttggggttggatacatatagttgaagaattatccccttgtttaaagttacttgaatgagagacaaaatacttcgtatccatgaaatgaaataactcatgaaagcagctgcatgtttgaataatttcagttctcaaagtcagtcaagcctttaaaactagttattgttttgtgtttttcatattagtacctactattgtaaatcctcaaaccaaggctcagggatgacactactagagtgacaatggagaagcagttctcctctttaaaaaaaaaaaaaaaaaaaaaaaagtgggccaggtgtggtagctcatgtctgcaatctcagcactttgggaggccgaggtgggtggatcacctgaggtcaggagttcaagaccagcctggccaacatggtgaaaccccgtctctactaaaaatacaaaaattagccaggtgtggtggcagacgcctgtaatcacagctactcgggaggctgaggcaggagaattgcttgaacgcaggaggcagaggttgcagtgagctgagattgcaccactgcacttcagcctgggtgacagagcaagactccgtcttgaaaaaaagaaaaaaatgtgtccacaattttgattagaaaactttcctctttttcacgagagaacctccagtcttgtaaatgtcagtcatggttcagattatttattttaaaaagatgtaatcaaaagactccaaatgtatgtatttttgttccaaaaatgcattttgcctctaaagagaatgtcagttctattccattgtctttagtttctttccctaatcagatataaatgaaagacttattcattggtgtccattggtgtctttagttttatttgtaattcataaaactacttgaaagaaatatggatatactattaagtattgttttcaagtaaagggccaaggaacagcacaaagaagaaacagaaagaaaaagataagatagagccctattcttgctctgaaaaatgagctgcctgtggggaagctgctcccctaaagaagggatcagggatatcttcctgtgatattcactggaatactgtctcccaacagacactggcaagtgcagaagacctcacactgccttgctggcgattttctcctcaatagagtatatttaagaagaaaactttgaaatcttaaaagagagcaaaggcagcggtattagggtaagactggataatgctctggatccattaccataaggatagcaaataacaaagaaaagtaaaatgtatctgacagagacgggctcaggtgctcagttaccaccttggaatcactcttggtccatccttactgtctctgtacatttttctcgcacaccagcacagggcacttctttgctgcttctgtttccatcttgccaggatccatcttcacttttgtgacaatcttcctttcagttttagtaaaacaaccacaagtggcgatcgtaagaaatttctggaaattccccattgttgctgtacaacacttcctattataaaattcactgtgagtaaagaattaaaatatgaaattctagctaataccaatgtaatgagtagctctaaaaaagttttaatgttttcttagtaagatctttttattcattcattgtcatatcttattcatctttgcatgctcagaatttgggcaaactgtaaaaatagaaatatggcaacatatgtgtatgacaaagtacgtatatatgtatgtgtatattgacaaagtatgtgtatatgtatgtatattatatatatacactatatatatgtgcttgctaggcacatggtgaataccaaaaagtaatataaagatgtactttaagtttgttttaaactataaattataaaggaattctggtttcacaaaataataaatcagaagagaataatttttagaattaaaattaacataaattcatactaacatatggcatctgttactggatttgaagaattttcacagatcacatttataaggtacatttcaacaaatttataattcactgtcataaagcaacttgagtaagctcagggttaaaaaggtggaagggtaggatcaaaattctaggtagcatttatgatttgtggtaggttagcagagagttaagtacatgtaagtaccacagtgaagagcaaaaatggctaatagcttacaactgtgtaccaagtatagttcagagttctttttatgtatttctttattaatcttaaaacatccctattgatatcataattgtacaattgaagaaaattacacaaagtgagaaaatctaatttgccaagggccatgtgtatatacatgtatatatacacataaagtaagtggcaaagctgtcctcaatctaggtagcttaaccacaaagccaccctctcaacctctgtatgcctctgtatgctgtttccaggaccttccagatgccaaaatccatggattctgaagtcttttatataagatggtgtaatatttgcttataacctacatgcatcctactgtatacttgaaatcatctctaggttaattacaatgcctcatacaatgtaaattctacgaagatagtttttatactgcattttttagggaataatgatgagaaaaaaaagtctttacatgtttagcacagacacaaccattccttttttttctgaatattttcaacctgtggttgactgaatccacagatgtggaacctgcagataccaagggctgactgtacctaaatggcctgtacaaagagcaataagtcatcattcaatatcaaaagtggtaaggaatcaggaaaacaaagatacattgcaaagaccaaagtagtgaatctaaccaaagaccaggaatagtttaggaatcaggaattcaagaatcaagctaggtggagcaatagcagctacaattagtgaagagagagacgggtactgatgcaaagcaccctcacatgtgtttttccagagcaaatcatggcttataagtggtgtgagtaatgtgcatagggaaatgggctccagatggctggaaagtcagaacaagtttgatactgatcttgaaggaagtgtcagctactggtaatcttttgcttttttttttttttttttttaaggcagacctttgctctacggcccaggctggagtgcagtggtgcgatctcggctcactgcaacctccgcctcctgggttcaagtgattctcatgcctcagcctcattctcatcccagcctgtaatctaggagctgggattacaggcatgtaccaccacaccaggccaatttttgcatttttagtagagacagggtttcatcatgttactccgactggtctcaaactactgacctcaagtgatccacccacctcggcctctcaaagtgctgggattacaggcatacgccaccacactgagccagctactggtaattttgacactagttggtaagctgttagcgctctccaactttaacaaacagattcaaacctcgtctcaattactgttgtgctggataattcttgaatagatcacattgtcttgtgcaacagttccttctaaaacacctttgagatggcttaacaacttatactgggaaaaaagtggtggacagtgtgtttagaatcagaactaaaaaatgctcaattgattctgtaagtccttccacctgtaaatctgagtatgaattggaactttcaggaatccacctggtatgaatgtaaactattactttaaattggaactgaaaatttcaattgtaggctcgatgtaagaatagtgagtttactgcctttgaaactcacccatgtctccatttgcaactggatatattttctctttgaaattctcttcaatcactctccagtcctgaatagcagcatcagtaattgtgtcaacagacatgatcattttatgatctgagaaagctggactgacaaatgcatcgccacttgaaatctaacctaaagatagaaacctgcattgtagagcagaaggctaagctgtacttacataacagcagcaacacttacaacctgtgctgcctttgctttattttttaaaggcatgaccgattttctatttcagatgacagaatattaaaatgttgggcagtgatgttttcaaatccacataatttttagtctatatcagtgataatataagtcactgattttttaaccggaagtcaggttagcagcaagatttctaattataactcattgctaatatttcatatggcttataaaacctatgaataacattgatttatgtaatggaaactcagaaaagaatagagaaaattatataaaaattactgtattcttggatcagaaattctagaaagatgtttgtttatattttgagatttcaagcagcaggggggaatgcttttagtcagccttctattgttatctataaaagagtgaataaataaataaaaatctctgcatagagatgaaatgaaccagcaaaataccaaaggaaactaacaccacagataagatttactgatcaaaattcactgtttttgtgtaggaacacagcatggtaaataggccttatataataaatacattattttctataacagatttctccaagaagacccaaaatgctataaagcagcactgcaataattctataaatatcattttgaagtactagcattccaatttcaagaaataattaaacaattctgaagttgatgacatttaggaatgggataaggacagtattgctattcaatagaaatgaatcaaatgcatatttatcaagttggctaaataggaatgctaagaaaatatacacataaatgataatcctttaagtaatttcattattatagcagcccatgaaatcatgtgagctttttcaatcctctctttaatttgaacttattgtaaacatttgacgttcaatactagaaatcagatcttttatctaagacttgattagtcagctttacttccttgtgacagacacactacatggtctactaatcctatcagctgtccacacattgaaatatatattcctgctcaaatctttatttcactcaggttaaccataattgccattattggcaccttttgtcttgtacttcctcagaaaaaacagctacgaaagtagtaaaataggccaggcgcagtggctcacacctgtagtcccagcactttgggaggccaaggtgggcggatcacgaggtcaggagtttgagaccagcctggccaatatggtgaaaccgcatctccactaaaaatataaaaattagccgggcgtggtggctcgtgcctgtggtcctagctacttaggaggctgaggcagaagaattgcttgaacccagggcggaggttgcagtgagtcaagatcatgccaccacactccagcctgggcaacagagtgagactctgtttcaaaaaaaaaaggtagtaaaataaaaaccaatccaggatgctataccatattattaccaaaacaataacacaatggtctgatcaacagcagcagctatagattctccctcatttaaacttgaattatcttttattttatttatttttttattatttatttatttaattattattatactttaagttttagggtacatgtgcacaacgtgcaggtttgttacatatgtatacatgtgccatgttggtgtgctgcacccattaactggtcatttagcattaggtatatctcctaatgttatccctcccccctccccccaccccacaacagtccccagtgtgtgatgttccccttcctgtgtccatgtgttctcattgttcaattcccacctatgagtgagaacatgcggtgtttggtttttttgtccttgcgatagttcgctgagaatgagttcatgtcctttgtagagacatggatgaaactggaaaccattttatttatttaaaaattatatttattcatttctttcattttaagatgggaatgtgaatatagggcattttcttttaagattaataaataacatctaattgacacagtcttagaaaacattattcccctataccctgatatctgaaaatataattcagagggtgaatataaaaaattagacatgataaaaccataaactgctaagctggatgggtcattaaaaagagtgaactaaagtggagagagataaagtgtcttgctgtccaaagctttatgtaggagtatttggggaaaacactagataaagataaatcacaaaagatttacttgcatcaaaggcatcaccaaaaccttgtaattttctgtgataataggaatgtgtacactcccagtttatttcaaactgtttggtatgggtaacagaatggctggttggcttcccagttagtttttgagtcttaattaacaagggagtcctgggatcaggaatgtctattatattgaggttcaaagaaatgcaatactaagtgtttattgttgaagaaatgctcagttaatgtaaattaaataagaagtttcaatgtggaatataatctaagaatctaaatttaaacatgaaattcaggtacaatttattttaaaaataagcgaaggttgcccggcgtggtggctcacgcctgtaatcccagcactttgggaggccaaagggggcagatcacctgaggttgggagttcgagaccagcctgaccaacatggagaaaccctgttgctactgaaacatacaaaaaagttagccggtgtggtggcatatgcctgtaatcccagctacttgggaggctgaggcaggagaaccgcttgaacccaggaggcagatattgcggtgagccgagaccataccactgcactccagcctgggcaacaagagcaaaactccatctcaaataaataaataagcaaaggttttaaataaacaagctctaaatgtcaaaaagatgacccaaagatttactaaagaaatatatggttaactaattattataacaaatgtatccaagctgtttccgtactgcccattgtacaatatgtggatatgatgtttgaaagcttagaagcctgttataatgaacgtagtaatcgcatgccccttagcacttacgtgtgcttcctcatgttacactgcacttaggcatctggccttgtataatacacaggcataacattctacccctcggtgatttacggcatcaacagtaattttaaattcttgatattttgaaacattcttcttaagttctcttttataatatcaaaacttctacttgccctgtggtttttttttaaaaaaaaaacatatttaatcaaaaatattcattatttctcatgtcaacagtgcaaatactaagaaattgtagtgtaacagaatgttgagtaggatttttcctttacctggaaatccaggtaaatcctaaagctgaaaggtctgggaagagcttcccaaaaactacctttactttacattctaagaggagtcagagagccatcctgaaggccaaccaagacatgccagaggcagccctacttgagcaagttcccatccactcttcctcttaaatctcattttttagggagaaaactgagagggaagggctcaagggcatcaagctgtggcttgtcagcctctgggaaagagccatgtttaggggagtggctttggctctttccctcaaaaggacagttctccaactgaaccacttgtggagactgctggtagctgcataaaaagatatcctaggtggatatttgctgaccaacaaaacctacaggtatacttggggctaccacaacagagaaggatggtaagatagtttattttagaacttcctgatgcatgaaatttattgatttctcacatgtgtgaaagtgtacattaacagagaaagtgcttatcgctagaaatttctaaaggctgcagaatttctggagaactctaaaccagtggtataaaaattataatagagtttcatcaggtccaaggcaaaaagttagggtgatggttatggttatatttaggtctagtagatggctaccagaaccctttggagatgaggaagagaaattagcagtttgggtggtcccacctccatgtgaaaaagaaatgaaagtcagatgatgggcaggtgccctagtcttttctagcagccactgggcaatgagacatctttcctagcaaaagtgttttaattgggggttttgatcaatagcaagggccaagagatgataggcctgctgttttctgaagggctcctcatcaaagaagatgctagttgaagctgaactcaactcaaggaagcaaagcacactactgatttggaaaccacctgtcagccatggttaccagcatatggaaccagactgaaccagagtgaagtcaaagatatttccccattgcaactgatgccaatgaaataaaataaattataagagattgctaaaagcaattatattcagataaaccagataatctaaaagaaatggaaaaaaaacactagaaaaaacttaccaagactgaatcattaagaaatatgaagtctgaacatacctttaattagtgtggagattaaaccagtaataaaaaatgtccctacaaagaaaagtgcaggaccagatggcttaactgctgaattacaccaaatatttaaagatttaatgccaacccttctcaaactattccaaaaaaactgaagaggagagaacacttccaaactaattttttgaggccagcattaccctcataccaaagccaaatacaacaaaggaaaagaaagctaaaagccaatattcctgatgagtatagaagcaaaattctcaacaaaatacaagcaaatcaaatccaatagcacattaaaaggatcatacaccatggccaattgggatttatccctgagttgcaaggatggcaacatatgaaaatcaattaatcattaataaaggataaaaattccataatcatccaaatagaagcagaaaggcatttgatgaaattcaaccacaattccatataaaaactgacaagaaactaggactagaaggaaaatacctcaacataataaagaccacatatgaaaagcctacaggtaacatcacactcagtggtgaaaagttgaaagatcgggacaaaggcaaggatgcctactcttagcacttctattcaacgtggtaatggaagtcccagccagggcaattagacaagaaaagaaagtaaaaggtatccaaattggaaagaagcaaaattgtccctgtttgcagatgacatcattttatgtatagaaaactctaaagactcaattattaaaaaaacaaaacaaaacactgttagaacaaacaaattcaatagagttaaatgatacaaaatcaacataaaaatcaattgtattgctatgtattaatgacaaactatctgaaaaaattgggaaaacagtctcacttacaatagcatcacaaataataaaaatacctagaaataagcctaaggagatgaaagacttatatactgaaaattaaagaatattgatgaaagaaattaaagacacaaacaaatggaaagacatcctgtatttatggattagaaggcttaatattgtgaaaatgccagactactcaaagtgatctacagattctatgcaatccctatcaaaatcccaaagaaatttcatagaagtagaaaaaatcctaaaatttatattaaactataaaagaacccaaatagcaaagcaattttgagcaagaagaacacagcaggaggcatctcccttcctgatttcaaaatatattacaaagctacaaaaatcaaaatgataaggtactggtataaatacagacatataagccaatagaacagaatagagaccccagaaataaatctgtgaatatttggtcaaatgatcttcagtgaggatgccaagaatatacaatggggaaaggacagtcttttcaacaaatagtgttgggaaaactagatatccacatgcacaggaataaaactggcacttttattattgccatatgcaaaaatcaagtcaaaatggattaaagaactaaatgtaagacctgaaattataatattgctagaaaaaaataggagaaaatctccatgacattcatctaggcaatgatttgatgaatttgacatccaaagcattggcgaagaaaacaaaaataaacaagaggcactacatcaaccaaaaatcttctgcagagcaaagaaagcagtaaaatgacaatctatgaaatcagaaaacatacttgaaagtgatatatctgagaatgagttagttttcaaaattggtaagaaacttctacaactcaatagcaaaaaaactaacccaacttaaaatataggcagaatagttgaatacacatttatccaaagaagatctacaaatggacaatagctatgagaacaaatgctcaacattatttcctgatgatttgcataatcaggaaaatgcaaatcaaaatcacaatgaggtatcacctcacacctgtcagaatgactattatcaaaaaaacaaccaatgttggcaagcatatggagaaactggaacccttgcacactgttggtggaaatgaggaatggtgtagtcgctatggaatacagcatggaggttcctcaaaaggtaaaaatagaactaccccatgacccagcagtctcccttctgagtatttatccaaaagaattgaaatcagggtctcaaagagatattagtattcctatcttcaccacagtactgttcacaagagtcaagatgtggaaacaatctaaatgtttattggcagatgaacggaaaagaaaatgagatgcataaataccatgaaatattatttatcttttttaaagaggaaattccgcaatatgtgacaacataaacaaaccttaaggatattagctaaaggaaataagccagtaacagaaagacaaatactgcatgatctcactcctatgtggaatctaaagaagttggtctcatagaagttaagtttagaatggtggttaccacttatatgagtcgaatcatataataatcaaattcatagaatgagagtgggatggatgttgccagggaatgggggcaggaataaatgagaaattactcatcaacattttaaagtttcaattgagcaagatgaataagctctagagacctactggacaacattgtagctatagtcaacaataatgtattgtgcacttaaaaatttgttaaggggataaaaaatgatgagttcatgtcctttgtagggacatagatgaagctggaaaccatcattctcagcaaactatcacaaggacaaaaaaaccaaacaccgcattttctcactcataggtgggaattgaacaatgagaacacatggacacaggaaggggaacatcacacaccggggactgttgtggggtagggggaggggggagggatagcattaggagatatacctaatgtaaatgataagttaatgggtgcagcacacaaacatggcacatgcatacatatgtaacaaacctgcacgttgtgcacatgtaccctaaaacttaaataataaaaaatttgttaagagggtagatttcatgttaagtgtttttaattataatacaacagttttttaattgtgtatgcttttagtggtaaataaattagctctctggtgcaaaaaataaaataaaataaaaagatatttccccattactgataagcctccggttaggtaagaacttggtctcatgtataaatcctcattgctcccacccagctataaagagacaaaaataagatgttatatccagaaagagactatcaaccctggacccaccatcatccttgcccatgagtcctcattcatactttgattggacaaaataacatctctagtttacagtggaggatgtaaggggtaagcttcagagaggatatgaggattgctgtcctaaatgatggtgaattaattttaatagccaaaaattatcagaaagctatggaatctgcactcaactcttctacaggacagaaaaggaagaaataatatcttgtttatatctccaacaaattaaaattatttggtaaactagttaaaattataaaaagaaaagacatttgcctactgttttatattagttttagtgaggggctcaaagttggaaagaaaaacagaacagagataatgaggcaaagaaggaaggaagcttcaggagtgtgtatgtgcctcctctttacttagaccttcccaacatgaattcaatattctgtttaaagtgaacattcaagatatcaaacatatccatagttacgttaacagaaagaaaaatatatattccaaaactaaaatatttccacataagccattactttcatattttaaaactctattaacacaggtaattcggaactgatgtaagtctttaaaactaagttatttagggttacctgattagcatacaaaacatctgggtttctaggttacatttctccaagaaaactgcagagctcctccctctctctccctctgtctctcacctctgcagactattatttaaacttcatataattgggagttgagaagattttttaaatgactgactttgaagtaaatgattattcctaaatttatatgcagatcattaaactgataaaaagtactacaaaaatttatgttgtccttcattttcattataaatgaccacattaaagtttaaaaatattgatcaagctacaaaataaagggaatgattcttccataagattttgataatcttaaaattaaatcaaaacaaagggtgctgctagagcctatttggtgacttcagcattgtgacaattgtttgtagctctttaataagttggaaatcatttcaaagggatttgggatctagccaagatgaaacgtactgagcaactataaaatcactatcaaggttgatactactgcaaggaaaatcaaaaagaaaaaacaatcaggatacataatcctgaataaataaaccagagaagaacaatgcctttgtcaatcacctgctaaacagcagtgattcagccccatactctgaagacttttcaaaattccactctattatacttcttcaaattgttttctttccatttatgccccaaagtttagctgctccaatgaacacacaaaagatccacaactatctaacaagaaaaattttgtttctcctctcaaatcagtgggccatctaaagactgggtagtttcttactctagttttgttttgtattttacataatgtagtcacaagccaatgtttctctaatttgttccttaaaatgaagctggcaaaagtgccacataactattgtttgcacagaggtactttccaacctgggtatttaatgaccatgacaggctccatgtatccacatgtttgttcccccaagacatactgaacttcttcaaaaagaaacaaaaatgctgaaagtgaattttatttttaattatattctactacaggaagaaaacgacactttgtgtccacatcagagctgccagtcaaatactgacacaccagtaattctctagcagtgttagcacagagtcactaaaattggaatgaaaccacatggagaactcagggaggaagcgttctgtaggaactgttcatcagttttgctgtgacaatagaaggggccaagtggtttctctcagtaatgtgtggtaaagcgtgtcttttcccacatcctgccagcaatataaattatccaaaaatgcagtctcatccatttagaaagaaaatctactctattatcagctgcaaggtgttagaactctaagctgaatacagaaaggcaaattacaggcacctaagtcaatcctaggtctgccagtttttcacatctaaacaatatcattcttagacatcatcctttttaaattccagtccttaaaaatgcttggagttatcaacgagggcttgaagaacaacttatccccataagatgtaattttctttctccatagtcacctgaattgagtctattatttatccacatggatttcatgaccagaacattctgattttcactgtaactcttccctggctccagattacatcaagttttctaatttccttgattcttaaactaacttgatattttcttttgttgtctattgcctttttcttttccctagctacttccttctcatcttgtttattttcaatcaatactttgccctatgcccactctctatattacatattcatatgttctggccttctgtaatttcatttgtaatttcagttcacctgtacttccccactgggagacagtgtagaacagtgttggatgaaaaatccttgcataagtgagcatgaagtgggatatgggtcctagacatctgtcaggtaggatacttcttaaattataactttagggctcaaagcattaagccactccagctgcaatagcctacttcattgtatgaatataaaataaactagacattagaaattcaaaatatctcctgtactcctagacagcaatccacccactgacaagaagtctctaaagaagtttttataagtggtaacaatgaataattttgcactagtcccatcacccatttattggaaggttgaagacttattgaaaaacatcttcctttacctgtatgccactgacactaaattataaaactactaaaaatttcaggagcattctctggcattccccccattacccctacccataggaattaccatgacacttcccctggctactccagctcaggaaaaccagacttgggaaagagcaacaacacaatccaagactctttctgaaaataggtgtctagttgattcacatcttctttcataaataccccaaaaagttgagatccccaaaccttggcttttcagaacatatattcagaatgtcagcagaatgagttgtgatgatattcaaataccatttctgtgatgtttgtcactttttttctaaatctaattgtctgcataaccaacaggcaactaccctcttcataaatgaggcaacattgcatgaggtcactttcaaaccacactgacacagctggcctaggacctggctcatgacttgctgttcatcgctccagagcccttctcagtctaagtatgcaagagagaataaagtcattagagatcatgtaattatacaaaatgtaaaggaaatcattactaatacaagaaatttttaataaatatcagaaatataaagtagaagtccataggttgatagataaaaataagtagaaaattcacaaactgaaatatactgcaagacagcttcaattacaatctattttcccaaagggaaccccatggagacacagcacacagagataggaagtaatttagattttatgagatttaaatgagattaaatactgtactgaaaataaagagtctaactacagagccattgatgatctatatacaggacaaggatgggagacccatcccactcaactggcatttacccctgggcaagaaaccagagggctcttctttaagaaaatgaacaaaattctgggaatagtaagatttctagtgtgtgtgctggcccttcccataggaacaaatatcctctttgcctgccaacaagtatttcccactctcctttgatctgcatagagtctgaatccctgggctgccttccccttcagatcagaaatctagggcaaaaacaagtcaatcgtttttcatagcagcagaggagaccaattccaaatatacaggattttttttttttttttgagatggagtctcaccctgtcacccaggctggaatgcaatggcatgatctcggctcactgcaacctctgcctcctgggtaaaagtgatactcctgcctcagcctcccgagtagctgggattacagatgcatgccaccatgcctggttaattttttctatctttagtacagatggggtttcaccatgttgggccaggctggtctcgaactcctgacctcgtgatcctcctgcctcgacctcccaaagtgctgggattacaggcataagccaccacacctggccccaggaatgtcttaaaccatgtaccaccacatagcaggagaggacagaagataaaacgaaactctctggtcttggaagacactgaattattccaaagaaggaaaatgaacttttaaaagttataagtaatatagagactagagaggaaaatacaaccatacatacaaacataaaggataaaattgagaacatgtagaatgcataaagcaaaaagataaatatgagagacagtgttagcaagataaaggatcatcccacagagtattatttggttaagagaattccaaaaaataaagaccagagaagatttgtatggtataatatctataaaataatacaaagaaatattccaatgctgatagatagacatgaatgtctacatgacaacatccgatggctgctctgcacagggaatgctggaggatgccaagttacccctagtttcctacaaaggtatttgacttattattgacaatactaggtactaaaaataacaaagtaatacctttaaagttctgatggaaaattttctattattgtttccaaatccaacaaaactatcaattgaaatgtaagccagaataaagctatctataagacattttctgaggtaacttccttcctttgcacctatcctgggaatttcttttaggatgcactccaaacatgcagaagtaaactaagaaggaggaaaacctggaatccatgaaatgatattccatcccagaatggtagagaaaggagagaaagagggtagtttcatggtaaactaaaaagcaaccagcaaagctgaaaacaaggagacacagaggtacagaagtgacatcctaagggggttgaatgaagacccacaaagataatgaagacagagaaagacacagagagaatgcataaccacaaacggtgcaagaaaaactaaaagaatgatgattggaaacaacattaaaattttttaaatctaaatataaagcaagtaaaaatgcattagaacgttaagcgatagactgaatataagagaagacaattcaggtgaccttgatgccagcaacatcctcttttaaatggccccaggtttatggtgtcagatattttgaagtgggaaatggaatcttagtccagaacttaaataatgtttacacagtcatcataatgtaaatgtttgttttctcctattagagtcaacccaggaacaaagaaaaagaaaattttattattctcacaggatagaatgccagtgttcacaatgggatgatgtaaaagtgtggctcaaaacaaacaaacaaaaaataagttgtatatgtgagaagaaatagtagagcaaagtatatatattttagcattttttaatgaaacagggagtcaagatatatgtcaaaaagctgtaaccaaaaatagaggattaagtatacttttctggggccacaaaatttactagaagaaaaatcagaatctcaaaaatatacaaagcaagctttggggagggaagagggtataaaagacagcaaaagtaaacaaattcttacctttatttcattttatttattttttaattttttttttttgagacagagtctcactctatcactgagactagaattcagtggcattatctcggctcattgcaacgtccgcctcccgggttcaagtgattctccttcctcagcctctcaagtagcttggactacagggagtgtgccaccatgcctggctaatttttgaatttttagtagagacagggtttcaccatgttgctcaggctggtctcaaactcctgagagtcaggtgatccatccaccttggcttcccaaagtgctgggattacaggcatgagccaccatgcccatcctcaaattccaacctttcttatcacattctcagaaaataacctaatagatgaagaagttgaggtataatacttgtagttattaacaaaaatactgcaaacaattcaaaaaggttgcctctctaaggaggtccaaaggtctggagaagtgaaatcagatattcttgcttttgacttaaagcaatcttctaaaataaaaacttcaaaagaaattaagaagtaaaacttaaaacaccattttaaatgacactgttaccatcacccacctaccctggagaagaaatgcacatttctggcttcagccaatgaggcttgttcaatgttccaacactgaaccatagctattggtttaataaatataccattacatcaaaaccattactatagttactggcagaacattgaactcctcatcaatgtgggagataagcaactccactgattttggctggaatataatacagctcttagataaccttagagagttccagcatgactgactgcaggcttggcaagcagtccagtaagtctgtaaacagagactaaagggatattaaaaaagaatgtgatgaatttggaaaaccatgtattcatcataacacattccaatgctggatgtgtcatctctaaggagttagggattttcccacctattatacggtcagtgatgaagctacatcttcaggactgaggtttgaaatcttactacctgaatcttcagatgtgttttccaactctctcttcactttgctttttttctacagagttaagtctttgagtgctttgtgatctgaaatcccccaaggcaactaacattccacttctttttcattttctttttaattagacactcacagaatacactgtactattttttttagaaacaggctccttttaattttttttagactgttttgcagactggccccaagactacatctactatctgataccattgatcgacctgactgttaaggtgtggactcagcacttcctgtgaagaggttccctgatgaatactgactctattaggcaagggtagtataacatgactcacagtcttctgtcagccctattgaattccaagctctgtctcagaactggctcgaattctctggtgattccttttccctcagttaactttgagcaaccatatactataagggtagacaacagatcctctagggcaggggttcccagcccccaggccatagactggtaccggtttgtggcctgttaggaactgggctgcgtagcaggaggtgagcagcacaagcattactgcctgagttctgcctcctgtcagatcggcacaggcatcagattctcataggagtgtgagccctattgtgaactgagcatgcaagggatctaggatgcatacttgttatgagaatctaatgcctgatgatatgtcactgtctcccatcacccccagatggaactctgtagttgcaggaaaataagctcagggctcccactgattctacattatggtgagttgtataattatttcattatatattacaatgtattataataataatagaaataaagcacataataaatgtaatgcacttaaatcatcctgaaaccatccctctcaccccaagtccatggaaaaactgtcttctatgaaaccagtccctggtcccaaaaatgttggggaccgctgctatagggaataaaataaaatctgctacttgactcatgagttgtatctttgaacttaaggtaagaaaaaaaatttaaccaaaccaacataattgaataatcagatgtcaatgtggaactcagaaacattatccttgtttacatacacactgttttttgaaattgtaagcctgtgatactctcgcatttgtgagatgccaacccctaaaaaaaaattgtatttcctaaggcagtataatgagttttgctttctttcttatatttgtgtctctcttattttgagaacttaacttccaagtgcaatttttggtcttgaacccaaatatatttctctcatcacccaattattagctctcatccactcttctcccagaatggttactaacaagaaacatgatggaggctgatggaggcaaccactgtgtaatgcaaacagctttagtattggtcaaatgctatagctggagagtcatgagtaagccctttctagtctctgagctttggtttcctcatctgtaaatatgtttaacatctgcaaagtcaatgccccatgtagacagggcccagcattatgtaatatttaaaaactaaattctcaccaacattttgagaagtgattaaaatatttcttgatgtcactcacaaatggcaaaagaagactcaattcacagcacagagcaaacaaaaagtcattttccccaactttttgtattgttctgttttggttttttgttttgttttttgaggcagggtctcactctgtcacccaggttggagtgcagcgatgtgatctccacccactgcaacctccacctcctggcctcaagtgatcctcccacctcagtcccccaagtaactggaactacatgcacaagccaccatgcccagataatttttgtattttttgtagagacagggtttcaccatgttgcccagtctgatctcaaactcctgaggtgaagcgattcatccatctcggcctcccaaagtgcttggattagaggcataaaccaccacacccggcccccagcttttaatatctctaatacttgcaactatccttaaatctctttcttctgttaaacctctacagaaatcctctatcagcccacactgactgactctcatctctttttctctcttcccacctttttggtattttcattttctattccttaaaatgtcagtgaggatcctgagctcctgagttttattcctcaaaatgtcaatgagctccagtctgactgcaaaggtgggtatttctctcttcactatcaaagtctaattataaaccagacttacacttacagcccccattgactctgttgtatcctttctaggtcagtgaggtggtcttcttgtcttcttcaaaagcacaggttgtgcaagcttttgactccaggaaaacatcctaaagccaaaccatgtaatcattcatttcactaccaacccaatggctccaaagcttatcgtagctgtcctgtttcagtgggaaattttatccataactcacagtcctatttttccaaacttggccatcaattccttaaattcttaggagtactggtggtttctaagtctaaccataggataaaaccacagtcaggagagcagaggtttaggttatcacccaatctaggcatgggtgccacatctccttcctccatcctgaatggtatctcgtttcttaacatagctgacatcttgggagataaagttgaaaagccaatttccaatctgcagttacctaaaggaacttcctagaagtcttgatttagtgtaatcatttaacactaactttaaaaataatccatttagtaatccaataccaaatagtagattatcaccccaaagggctactcttaatctcagagtagtaacaaaatttccctctaactttagtataatatttcaaggacaacgaaatacaaatttctgtgaaatttccaaagtgtaaaacactatgaagttctactctaatatatgtcctagatgatgatttactccaaaaaaaaaaagtagatgtgacattttacattccagtactgtaaccacagaaaactcagctgcctcatggaactataacataatgtctaaacatcaaaaactaattcgaaagcaacttaagtattaattgaaatttctcagcaatgccaaaagataaatctctatgtaacccaatgcaatttcttaaaagcctttttgtaccctcttgagcatgctttctccgtggaaggcctctcaattcaaagcattttttttctctctctctcctcgcctcttttaatgtgtatctttctcattttgcagctgccccaaagactctctttcttctttcataactcttaaaatctcccaccaaacccaacccatgcttctttctctattccctccttttcatctcctaatctattcatttccttctcttatgtttttagtgtaaatcaatcaaactgatttcaatgattcctgactctccctctcattcatcagtctgattatgggcagcaaagatgtttctttttaaagagaagactaaagtgagaaactcttactagtcttatatccatatttttcctgttacatataaaaagcaatacccatcataatgggttgattggaaactctatgaaattatgtatttacatatatttctgacatgtaggttttttaaagaatttttggttaaagtaataaaaatagtaagatggaaaacaggatacaatttgtcctctctggatacagctgttcagtctccctatcccatttccacttagcatcctaaagatcgaatggaaataacagaaaagagaaggataaaagatggcagaaaggagattagtagtttatgtgaggaaggagcaagtggtgtggagaagaatacagtttgacttagtgtgtctgctagctccatgagctgagctgtgcatttgccaggtggtgaggagggcagaggcagccacaaagctcccgaacagctgttcctttctcttcttccactcaacatttagagagtctgggcagtttaggggcagccactaagggagcagcagcagatggctgtcatgctgcagaggtgtactctagaaggatgaggggctccagttacaaaaagcagctatcttttatgtgctttaaagatatgtgctaaagtctacttgaaggctgtataaaggcacattaataaaaatcaccatttttaatttggtctttaattcagttctctaattttagtagtattttacattagatattagctatcggacaattattaaacttaaagaggaaaaaaaaagaacttaaaaaagacctatttttctcttcccatcctggcctcatccatttgaagcaagggtgacaaccttgttgtcataaccctacaaggaaatttttcacatttaacccacatttactgagaatctactctgtgtgccagtaatagtaccagactttttcatggccattatcttacgtaaagtaggtatgaaatggtatttttctaagtagaggtaaaggattctactcctcccactaaaaatacaaaataaaagaaaaagaaagacacaaaagttagagaaaacaaaatattagaagtttggttctgtttaaatgtatgcaaatccaattaggactaaatttacacttcaaaatatgtcaaaaattctctaacaggaaaaaaggacaaagttgaattttgttttctgttcttttcatgtgactttttgtgactggtattctttatacaaaatgactatggctcccataaataataaccaacaattctatagtattttgaagttttcaaagtattttcacataaaaaaattcttttgatctttaaaaactttctataaactaagaatctctatataataggaactttcgattcacatatgaggaaagatttcagtgcagtaacatgctgactggaatcagcctcaacactggaatagtgacatttaataagtccatggcaggcaatagacctgacaagtaggctttgctctgatgcaggcagaacatgtcatcattgtccaactagttttataaagtttttatgagaagggaaaaagtagttggtattctaggaaaaggaatttttacttgcctttcttctagatcgcaccaggagtgtccataatttgtcaactgaaataaagctcagccccagtgtcttctaaatttgtccactaactcattcacctatgcaaaattgtggcatttaaggaattagtaaaaactaattaacttaaataagatatttatttaatactctgttaatcaatgttatagaaaaggttactaagtaaattttgaaatgatatatctcccttaaaaggtccctaaattccttaaaatgagatcagataaatattaaggaaatattacagaataaatcaggatatttggtaaaaagaaaacgtgcttatcccatatgaaaaaaaaaagttgtggttagaacaaattagtatttttaaatttttttcagtaagttataaattaaatacatgcctattcactaataattcaaatggccaaagagcactgttaaatgatggttttctctgagggccatctttttatagacattgatacagttaatcttcctaatgtccagctggcatcaggttatttccttagagtagtgactgataatagttatcggataaaagccatgttccaagttgaaatccaaactccaaaattttctttttaaataggacttctatgatttctcttcttagtccctctgtttttcatgaaaattccaagactccctctttttgcctttgtgcaatccattctctacccctggtatttcctatcttcatgtcccttgtccagaatagtctagatccatctagcttaaatgtgatcttcttcttaaggctttcttctttttcctaaaatctctttcttctgcattctcgtctacttaagattgatcatgagctccaccatctcctggtctcccatatccaatcagtcatcaacttctgcctgatttccatttatcggtattcctgaaagcacgaacattggcatcagatatatatgcttttgaattttagctatgtctccactagctgaatgaacttaaataagcaacttattgttaatcatagtttcctcttctataaaatggtcattcaaagagtacctaattcacagaattatagtaaagatcaaacgagttaataaatatgtaattcaacttagatggaaaattcaatggaagccaacatttctcaaagtaggtttaaggaatattggttccataaatattcttcaaataaaaaggaattcgtagttaaaacaacttattaaaaagtatacctaatacccacttctctgtcagtcatgaagtatattagcacattaaagtctccaagaggtcttaaaaaaatagaaaaaaaaacaattatcctaacattccctaaacttatttgaccaggaagcctttttatgcatatatagtagctacttaaaagcctgcagaaccagtgttctgaggaaggctttgagaaaatgcttacctggacaagaaccacagctatcatcttgaaagttatttcagccttaggttttcaatttttagaaaaaaataaaaaataaaaaataaaaacattgtgaaagagaccatctcctaatgttcagagtcattagaaattctcagaaaatgaataaaattctgccctttgggaagatatgcccaaaagggtagcagaatggtattagctttccaaggccaattacttcttaacaatctcttaaaggatatgaaaaagttctatttttcatggaatgcccagtaattgcttatccagctggtagcagatgcaaaacttcatctcaggaggaaagcttaacgtacaaatttgtgaagacctgataaagagtgagaagaactctcaggagtctcaggaaatgaataagttcatgcctgtgatgaagacagaattgagacgtgatcactatacctgaggtctaatacatctaccttcaaacataaaactgtttactctatacaaataaaagggcaatacaggtacacctcacattacggtgcttttttttattgtacttcactgatagcatgtttttttgcaagttgaatgccgagcaagtctctcagcaccatttttcaaacagcatgtacccacttcatgtctctgtgtcacattttggtaattcttatatttcaagctttttcattattattatatctgttttggtgatctgtggtccgtgatctgttttgttactattgtaattgttttggagtgcaacagaactacacctatataagtcaacacagataactgataaatgttgtgtgttctgactgctcaatgaaccccctgttcccccatctctatacctctctttgggccttgatattccctaagaaacagtaatattgaaattaggccaactaccaacactacaatggcttctaattgttcaagtgaaagacatatctaactttaaatcacaagctagaaatgataatatttagtgaggaaggtatatcaaaagctgagacagataaaaattaggcctcttccaccaaatagttaaccaagttgtaaatgcaaagaaaagttattgaagaaaataaaaagttctactccagggaacacataaataataagaaagtaaaacagccttattgctgatatggagaaagttttagtggtctggatagaagaacaaaccatccacaacattcccttaaaccaaagcctaatccaaagcaaggtcctaattcttttaagtctatgaaagctggcagaggtgaagaagctgcataagaaaagctcgaagacagcagaggtttgttcatgagatttaaggaacaaagcaacctctataacataaaagggcaaggtgatgtagcaagtactcatatgggagctaaagcaagttatccaggcaatctagataagataatgaatgaaggtgtctacaacaatcaatagattttaaatggagaagaaacagccttctattggaagaaggggccatctaagacttccattgctagaaagaagtcaatgcctggcttcaagcttcaaaggagaatctgactctcttattagggcctaatgaagcaggtgactttaaatcgaatccaatgctcattgaacattctgaaaaacctagggccctttagaattatgctaaatctagttggcctgtgttgcataaatggaagtacaaagcctgttacccaggttctcactcaggctttgtagtttcatgtatgttggtttacaacatggtttactgaatattttaaacatatcattgggatgaacttctcataaaaaaagattccctttaaaatattactggtctttgacaaggtacttagtcaccccaaagctccagtggagatatatagagagatcaatgttgttttcatgcctgaatatacaacatccaatctgtaggccaaatatcaaggagtaatattgaatttcatgtcttattacttaagaaatgcacttcttgccaggagtggtggctcatgcctgtagtcccagcactttgggaggctaaggcgggtggatgacctgaggtcaggagtttgagaccagcctggccaacatggtgaaaccccatctctactaaaaatacaaaaattagctgagtgtggtcatgcgcgcctgtagtcccagctacttggaaggctgaggcaggaaaattgcttgaacccgggaaaggaggttgcagcaagccaagattgtaccattgcactcccagcccgggtgacaggagtgaaactctgtctcacacacacacacataaaataataaaaataaaaaaataagaaagaaaagaaaagtaatacatttcttaatgctgtagctgccatactgattcctctgacaggtctggagaaaatacattgaaaacttcctggaaaggcttcaccattctagatgccattgagaacattcaagattcattaaaagaggtcaaaatataaatattaacaagagtttggaagaagttgattccactctcatggatgactttgaggtgtttaatcttcagtggaggaagtaactgtagaagtgatagaaataccaagagaactagattagaattggagcctgaagatgtgactgaattgctacaatctcatgataaaacttgaacagatgagtaactgcttcctatgaatgagcaaaaaaagtggtttcttgagacagaatctactcctgctgacgatttggtgaacattgttgaaatgacaacaaaggatttcaaatattacataaacacagttgataaagcagcaatacagtttgagattcattccaatttcaaagtaagttctacagtaggtaaaatgttaccaaacagtatcatatgctgcagataaatctttcacgaaagagtccatttatatggcaaactcaatgttgtcttattttttaaaattgccacagcctccccaaccttcagcaactgtcaccctaattattagcagccatcaacacagaggcaagaccctctaccaacaaaaagattatgactcagtgaagactcagataattagcactttttaacaattattatttcaaaattaagatacgtgtttttttagatatattgccatggcacacttaatagactagagtatactgtaaagataactttttttttattttttgagacagagtctcacaccataacccaggctggagtgcagtggtgcaatctgggctcattgcaactccatctcctgggttcaagccattctcctgcctcagcctcctgagtacctagaattacaggcacacgccaccatgcccgactaattttggtatttttagtggagacagggactcaccttaatgtgcatgtctgacactaacctgtaatatctctgaggtatgcctataaatgtttgttgaccgattgtctcaatgttacaagctgaatgtaaccaaattttagatggcacagcagaaattccgaaatcatttaattttcttttcatgagaagcaaaataagactaccttacatttatagctcatttgtggtctgctcttctataaaccataaaaactcctaactttacaaacatagaacttaactcttctttcatcttcatcaaaaagtgcttttcaaacaattagcatttcccaaataacgtttgtcgtttccgcttaggcctgttttagtctacctaatagaataaatttagcttccctgtagcagagccctatttttaaaagcatcttttaatacatgctgctgtgagagcaaaaaaaaaaatcatagtcattttgaataatttttacatgtttattaaaacaatggtaagcaaaataagtggttattatatgctctcatgttagtcttagtattcataagctaaaagcactcatccttctttaaaataaataacccaattgaaaataaaatgttattaatcatataaagaagatctctgaattcttaaacactgtgaattcttaaacactgtgagtatagcatcgcttctatttatacaaataaatgaaaccacaaacttattagagtaccttttaactataaaaataaatagataagcagaaaaatacattctaacctaattttcaatatctgaaataaataattagagaatatataaggaagaaattttggtgaataactgtagcaaattcctaattctatgaatatggaaattgaggcactacatattaaacaataaggcataaacccatctgagtattagtgagaattaaaaacacatctcctaatttccagttatgcttttcgtatcatcacaatcttcataaggtttgtccattaagttcatttgtgccttaaacaacacgaaatccacccgttacacattttatggatactatttataaaaatcagccaattcttcaataaactaacattagaaacaggataattagttgcctgagtttaaaaaattgaacgcaaatcaataaacataatcccgcatataaacagaatcaacaacaaaaaccacatgattatctcaatagacacagaaaatgcctttgaaaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactccttttcaacatagtgttggaagttatggccagggtaatcaggcaggagaaagaaataaagggtattcaattaggaaaagaggaagtcaaattgtccctgtttgtagatgacatgattgtgtatttagaaaaccccattgtctcagcccaaaatctccttaagctgataagcaacctcagcaaagtctcaggatacaaaatcaatgtgcaaaaatcacaagcattctcatataccaataacagacaaacagagagccaaatcatgaatggactcccattcacaactgcttcaaagagaataaaatacctaggaatccaacttacaagggatgtgaaggaactcttcaaggagaactacaaaccactgctcaacgaaaaaaaagtggatacaaacaaatggaagaacattccatgctcatggataggaaaaatcaatatcatgaaaatggccatactgcccaaggtaatttatagatttaatgccatctccatcaagctaccaatgactttcttcacagaattggaaaaaatactttaaagttcatatgaaccaaaaaagagcctgcattgccaagacaatcctaagccaaaagaacaaagctggaggcatcatgctacctgacttcaaactatactacaaggctatagtaaccaaaacagcatggtactggtaccaaaacagagatacagaccaatggaacagaacagagccctcagaaataataaccacacatctacaaccatctgatctttgacaaacctgacaaaaacaagaaatggggaaaggattccctatttaataaatggtgctgggaaaactggatagccatatgtagaaagctcaaactggatcccttccttataccttatacaaaaattaaatcaagatggattaaaggttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagggcttctgcacagcaaaagaaactaccatcagagtgaacaggcaacctacagaataggagaaaatttttgcaatctactcatctgacaaagggctaatatccagaatctacaaagaactcaaacaaatttacaaaaaaaaaccaagcccatcaaaaactgggtgaaggatatgaacagatacatctcaaaagaacacatttatgcagcccacagacacaggaaaaaatgctcatcatcactggtcatcagagaaatgcaaatcaaaaccacaatgagataccatctcacaccagttagaaaggcaatcattaaaaagtcaggaaacaacaggtgatggagaggatgtggagaaataggaacacctttacactgttggtgggactgtaaactagttcaaccattgtggaagtcagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaatccaaatgtccatcaatgatagactggattaagaaaatgtggcacatatacaccatggaatactatgcagccataaaaaaggatgagttcatgttctttgtagggacagggatgaagctggaaaccatcattttcagcaaactatcgcagggacaaaaaaaccaaacaccgcatattctcactcataggtgggaattgaacaatgagaacacttggacacaggaaggggaacatgacacaccgggcctgtcatgggatgggcggggggagggatagccttaggagatatacctaatgtaaatgacgagttaatgggtgcagcacaccaacatggcacatgtatacatatataacaaacctgcatgttgtgcacatgtgccctagaacttaaagtatcataaaaaaaagaaaaaaaagtaatgtgaagtatgaaaaataatatctgaagagtttactaaatttatgtaattaaaaatcccaagattaaaaaaaaaaaaagaaaaagaaagaacagtcactaagtttaaagtatgttcttagtaggggatttatatagcatatgacaactgcggtctcctctgattcccttcagaaaaatctcacaaagatgttgggtcagcagtctcaaggacaatgtaatggcttcatctagaactcatatctgatttttgaatctaatgaaataacctgaatgtaaaaaaacatatgtacccatggctctgacagctagaaaagcagtcaaatgagaactagttacaggcaagtctagaagagtattagaataacttaagaaagacagagcagagacaattttaatgaagtcttggatactcagtaagagtttggttctagtgccatagacagtataatgttgatagaaagttgaaaagtgttttgatttgcctttctctgatgattacctgttggtgggggtataaattatttcacccagtgtgaaaagcagtttgcagaattctcaaagaactaagagttgaactaccattcgacccagcaatctcattactggacatatgcccaaaggaaaataaatcattctaccaaaaagacatatgcactcatatgcatatcacagagctattcacaaaagcaaagacgtgacatcaacccagatgcccatcagtggtgaactggataaagaaaatgtgacacataggatttatgggggaaaatggcagatgggaggcaggactaaattgcagctcccactcagacaggcagagcagcatgtggagatacatcatgaacttttcctgaaagaactactggaggaacataccaggaaagccaaaagaatccacagaccctttgaaggaagcagattgctcctgcaggacccaggagacagcccaaatactatgagtgcccaaagtatgaaagtgggaaagggtgaacacacaccctcactggggaactcgaaggtccaggttatgggagaaggatttgaccctacctagaactgagacaatttagagagccaagtgaaatacaggagtagaggaagtgccagaagagccctgtgggctctctcggtccccagggaagccatttctgactttgtctcacagggatccttggggagggttgccagtggaactgggaaaagaccacagataaaaagaaacctcaagctgaactttgtaacaattccaaccaaacatgcaaaatttcttggacagaacttgggggagagagtgaatccagagtgcagacacaggcaggcaaggaggtatgaaacctgaaagtcctgcttgctttctcagctgggaggctggtagcctggggcaagttcttagccctgcttgcccactgcctaaaaacaaactcagtgctattgcggggaggcacagtgagagtgagactggccttttggattgcatgggagccgggtgaggcctgtaactgtcggctgtcccccacttccctggcaacctacatgacacagcagaggcagccataatcctactggtaacgtaactccattgacccgggaaccacaaacccatcccccacagcagctgcagcaagccctgcccaaggagaatcagctcagacatgtctaaccctgccccaacttgatggtatttctctacccaccctggtagctgaagacaaagatcagattctcttgggagttctagggctccagccactgcctgatcttccctatactaccacggctcatgctctcttgaaagtgccacctcctggcaagaggccaatcagcacaaaactagtgcaataaacaacaataatacaactacgggccctcacagaatgcatttcactcccctgccacctccactggagcaggtgctgctatccatgactaagagacagaaagatggttcacatcacagaactctgtgcagacaccccctagtaggtaagtactacatcaagggagcaccccatgggacaaaacagtctgaacagaagcccttgagccccagatcttccctctgacatagcctacacaaatgtaaaagaaccagaaaatcacttctggtaatgacaaaacaaggttgtttagcaccctcaaaatatcacactagctcaccagtaatggatccaaagcatgaagaaagtcttgatatgccagaaaaagaattcagaaggccaattattaagctaattaaggaggcagcagagaaaggtgaagtccaatttcatgaaataaaaaaaaaaaatgatagacggtataagggaaaaatcttcagtgaaattgatagcataaataaaaatatcacaatttctggaaatcaaggacacatttatagaaaagcaaaatgcactgaaagtctcagcaatagaattgaacaagcagaagaaagaacttcagagctcaaagacaaggtttttgaaataatccaattcaacaaagacaaagaaaaaaagaatttaaaaaaatgaacaaagcctgcaagaagtttgggattatgttaaatgaccaaacctaagaataattggtattcctgaagaaatctaaaggtttggaaaacatatatgggagaataatcgaggaaaacttccccagtcttgatagagatctagacattcaaatacaagaagctcaaagaacacctgggaaattcatcataaaaagattatcacctatacacattgtcatcaggttgtctacagttaagatgaaggaagaatcttaaaagctgtgaggcaaaagtgccatgtaacctgtaaaggaaaacctatcagattaacagcagttttctcagcagaaaccctccacactagaagagattggggccctatcttcagcctacttaaacaaaacaattatcagccaataattttgtatccagtgaaactaagcttaataaataaaggaaagatacaatatttttcaacaaacaaatgctgagagaatataccactaccaagccagcactgtaagaactactaaaaggtgctctaaatcttgaaacaaatccttgaaattcatcaaaacagaacatccttaaagcataaatttcacaggaccaataaaacaacaacaccataaattttttttttaaaaaaaggtatttaggcaacaaatagcacaatgaatagcacctcacatctcaataccaacattgaatgtaaatgacttaaaaactccacttaagagatacagaatggcagaatggataataattcaccaactaagtatctgctgccttcaagagactcacctaaaacataagaactcacataagcttaagataaagaggtggaaaaagacattccatgtaaatggaaaccaaaagagagcagatagtcattcttacatcagacaaaacaaactttaaagcaacagcagttaaaaaagacaaagagggacataatacaatgataagaggccttgtataacagaaaagtatcacaatcctaaatatatatacacctaacactggagcttccaaatttataaaatgattactactagacctaagaaatgagatagacagcaacacattaatagtgggggacttcaatactccactgacagcattagagaggtcatcaagacagaaagtcaacaaagaaacaatggatttaaactataccctagaacaaatggacttaacagatatttacagaacattcaaagataaatttaaaaatttcttgagacaaacaaaaatgaacatacaacatacccaaacctgtgggatacaacagaaacagttccaagaggaaagttcatagcaataaatgcttgcatcaaaaaagaccagtctaaggtaaacaacctaactttgtaccttaaggaactagaaaaataagaacaaactaagctcaaagttagtagaaggaaggaaaaaaaaaagatcatcacagaaataaataaaatagatattagaaactcactagaaaagatcaacaaaactaagagttggtttctggaaaagattaacaaatttgacaaaacttaaagagacacagataaataaaatcataaatgaaaaaggagacattacaactgatacatcagaaacacaaaagattgtgagggtacaatgaacaattacgtgcaaacaaatagaaaaactcagaaaaaaatgggtaaattccttgatgtatacaacttaccaagaccagactattaaaaaatagaaaatcttagcagaccaataatgaataaacacataaacagaccaataatgagtaaggagattgaatcaataatataaagtctcccatcaaaaaaaaaaaagcccagaacctgatggcttcattgctgaattctatcaaaaacttaaagaatgactcatatcaattatttaaaaccttaaaaaattgaagagggaatacttccaaattcattttacaagatcagcatcaccctgataccaaagccagataaaaacactacaaaaaaaaagaaaaacctcaagccaatatccctgatgaacactgatgtaaaacatcttcaacaaaatattggcaaacagaattcaaaggcacgtgaaaaagatcttcagcattatcaaatgggattcatcttagggatacaaggatggttcaacatatgtaaattaataaatgtgatacatcacattaactgaagggagaacaaaaaacgtatgatcatttcaatagatgcagataaaaaatatttgacaacattcaacatactttcatgataaaaactctcaacaattaggtataaaaactctcaacaattaggtataaaaagcatgtacatcaacataataaaggccatatatgacaaacccgtagctaacatcaaactcactggggaaaagttggacgctttttctctaagatctagaagaagacaagagtggccactcttgccacttcttctattcagtacatactggaggtcatagtcaaagcaataggcaagagaaagcaaatgaatctaaattagaaaagaagagataaattgtccttgtttgtagatgacatgctgttatttataacaaacactaaaaaactactagaactaatatccaaattcagtaatgttacattacacacaatcaacatacaaaaatcagagaacaatctgaaaaagtcaagaaagtgatcccctttatataactacaaaaaataaaacatttgtgaataaacttaacgaggagttagaagatctatacattgaaaattatgaaatactggtgaaaaaatttgaaaggatagaaataaatgaaaagatatcctgtgttcacagattgaaaaagttgatattgttaaaatgtccatactacaccaagcaatctacaattcaatgcaatccctatcaaaatgcaagtgccattcttcacagaactagaaaaaacaattttaaaatttgtatgaaactacaacagactttgaatagccaacacaatctggagtgaaaagaacaaagctgcatcatgttacctaactttaaaatgtacaacaaagctatagttactacaacagcatagtactgacatgaaaacaaatgtaccaatggaacagaatagagagccctgaaataaatccatacatttacagcaaactgattcaacaaaggtaccaagaacatacaatggggaaatcacagtcttttcaataactgatgttgggaaaactggatatctaccatgcagaagaataaatttaggtaattttctcacatcatatgaaaattaacttaaaatggattaaatacttaaatataagacccaaaactatgaaactgctataagaaaacataggtgaaaatctccatgacataggtctaagtaatgactttttggatgtgactccaaaagcacagaaaacaaaagcaaaaataaatgaggggactatacaaaactaaaaagcttctgcacagtaaaggaaacaatcaacaagagtgaagagacatcctacagaatgggagaaaatatctgtacattatacatctggctaaaggttttatccaaaatatatgatactcaaacagctcattagcaagaaaacaaataacctggtaaaaattgggcaaaggacctgaatagatgcttttcaaaagaagacatacaaatagacaataggtatatgaaaaaacgcccaacatcacaaatcattaggaaaatgcaaattaaaaccataatgaggtatcacttcacacatgataggatggctgttatcaaaaagagaaaaagtattagtgaggatatggagaaaatggaattttgcaagctgttggtgggaatgtaaattagtgcagccattatggaaaataatatgaagattcctcaaaaaattaaaaatagaaataccatatgatctggccatctcctactcgatatatatccaggggaagtgaaatcagtatgttgaagatatatctgtgctatcatgttcattgtagcattattcatgatagtcaagatgtagaatcaacctaagtgtccatcagtggatgaatggataaggaaaatgtggtgtatatacataatggaatactgtttatccataaaaataatgaaatactgtcatctgtgaaaacttgcatgaagctagaggacattatgttgagtaaaataagccaggtacagaaagataaataccatattatctcactcatatatggaatctagaaagatgcagagagtagaatcatggttaacaagggcttgggtcattgaaggatggcagaatttgtgagatattgggcaaaagatacaaaatttcacttaggaggaatatgttcaagagatctattgtacagcatagtgactatagataataatatattgtattcattaaaaatgctaaaagagtggatataaagtgttcttatcacaaaaatcatgactatgtgaggtaatgcttatgttagctagatttaagcattccacaacgtatatatacttcaaaacatcatgttgtacataataaatacataaattttatctgtccattaagaaatgatttagttcagttctgagacaagacatcactctaccctgctgttctctaaatacaattcaataaatgctcatggcaggtttcttcataactattttacaggtgtcctttaaagggtgggtggttaaacaaaccttggtacattcatcattagagtactagtcaacaataaaaagcaatgcagcaacttggatgaaattaaaaaaaaatatgctcagtaaaaaaagctaaatccaaaggcttacatactgtgtgatttgtttacacagctttgatgaaaattttatattactttatttttacttttattttaggttcagaggtacatgtgaagtttggtttgtggatttttgtttttttggtttttgttctttttgtttttgtttttgagaaaggatctcactgtgttacccaggttagagtgcagtgacatgatcgcagttcacggcaacctccccttccccagtagctgggactacaggcacacaccaccaccccagctaattctggtattttattttattttattttattttattttattttattttattttattttattttattattttattatttattttgtagagatggggttttgtcatgttgcccgggctggtctcaaactcccggactcaagtaatcagcctgtctgggcctcccaaagtgctaggattataggtgtgagccactgcacctggtccaggtttgttatacaggtaaagggtatgtcacaggggtttggtgtacatattattttgacaccaaggtaagaagcatagtacttaatagggtacccatgtttctgcaaaggacatgatctccttttttatatggccatgtagtattccatgatgtatacgtaccacattttctttattcagtctactgttgatgggcatttaggatgattccatgtctttcctattgtgaacagtgctgcagttaacatgaacatgcgtgtgtctttatgatagaatgatttatagtccggctggtcgcagtagctcatgcctgtaatcccaacatttgggcagccaaagcagccagatcatttcagctcacgagtttgagaccagcctggacaatatggtgaaaccatgtctttactaaagatacaaatatcagatgggtgtggtggcacaggctactcaggaggctgagccacaagaatcgcttgaacccaggaggcagaggttgcagtgagctgagatagcaccactgctctccagagtgggtaacagagtgagactctgaatcaaacaaaaaccccaaaaaccaaaactatattcctttgggtatatacgccagtaatgggattgctggggtgaatggtaatcctgttttaagttctttgagaaatctccaaactgatttccacaatggctaaactaatttacttttgcaccagcagtgtataaacattcccattttctccataacctcaccagcacctgctttttttgactttttaataatagctattctgactgatgtgaaatggcatctgattgtggttttgatctgcatttctctaatgattagtaaagttgaacgttttttcatatacttgttggctacatgtatgccttcttttgagaaatgtcttttcatgtcctttgcccacttattgatggggttgtataacattctagaaatgacaaaattatgtaaatagagaacacattagtggttgtcaggcattggggagtgaggcatatgggagagaaatcaatatggatataacaagacaacataaggaatccttgcgataacagaaatgttctgtatgtttactgtggtagcacatacgcagatataaatggttaacaaaatagcagagagctaaatacatagtataagcatatgcactcacacacacagaggaatacaagtaaaactagggagatctgaataagattgatagattatataaatgtcaatatcctagttgcgatactgtacaataattttgcaaaatgttatcattggaaaaaactatgtaaaagggacatggaatcttaattatttcctacaactgcaaatgtatctgcaattatctcacaataacatcaataaaaatgattttataacaaatgaaagcaatcaaatactagtaaaatttagtacatttctatgtccttgttgtatatttcatcatttaaatatacaacaaagcgaaataatctaaaaagaaaacattattttatacctcaaacccctgagattatacacaattgcatatttctgtaacttcatttgaaaatatggcatccataaccatattaacatactacggggagtttaggaggatcctagcttttggctctcctccctcagttaattattggaagctttgaggaaaggtgtcacgagaaatttttgattcagtcaataaacattaatttttcttttgtcttgcttttataaatcactggcctatctacaatgggaggctacatcttttaattaatatacaatacttttcagttcttagttgtaattatcttgtatgttttagatttcacataacgctgatgaaacccactgaacttttaaaagtactctaggatacaggattcacatgtaaatctaccacaataaaatgactttttaccagttattcctccatcccagagcttcattttatgtttataaccttattttaaccttatttattctacttgttatgttaaaattgtacttattttactcctcccaaggttaaaataaggattaaaatatcatttattttcatttttattactttattatctccataaaagtctagagtcactagcttcttttatccatctttggtgctggtataaaaacacatttcttgcttcacgttatgtctttaagcagcatcactttctttgattttccttttccaattaaaccactatctttgaactttttaattttcatggatacataatagttgtgcatatctgtggggtacatatgacattttgatacatgcacacaatatgtaatgataaaatcaggggatttaggatctccttcaaacatttatcatttctttgtgttgggaacattctgaatcttctcttccagctattttcaattatacaataaagtattgttaactatcatcatcctatagtgctattgaacactagaactccttccttctagctgactatatttttgtacccactacctagccttcttaattcccctcccccactcctccctgcctttgctaaccatcattctattcacaaaatatcacatgttctcagtcatatgtggtctaccttttttgtttcttctctatttctgttattttcagttattatttaaataactaattaaattcttgtggttttttcctattttttttataatgataggtttttaatgccctatttctccctgacaaacaactagacaccctgaatactagtagattgccctagaaacctgcctccaactggatctaataactgaattcagcttctcaagtcctaatcagattaaatcagatttggtatggcatagttttgtatattcttaaaatagtaacaagattacttcacctactctactgaacagcctagatgaatctatttgttattattattgggaaaatctaagttgagtatgaactaaaattcactaacaccctttattccttcttcctaatgtcctcacttatttatttgtcctactgtgataaatgtatcttagtaaggcctttcgaaatattttatgaattaaggctggaacaaagtagataaataggcaagagagaatctatcagaaaattaagtaaaatagaaaaaaaaaatcttaattacggctttgacttagctcacggactacctcttctccagctaatctgcactttgctgccaaagacattctcctgaagcttaaatgtgagcatctctctattgaaaaactcagtgtagctcaaaaatatcttaaaatgttctcatggtatatgaggtcttatagaatttaagttcaagctatctctcttcattccccacaatgttctctgataagatggtcctctgttctgggagctcagaatcatactcagtcccgtaaagaaactgagcctttatctaggtatgaaaacctagacaacgtcctcatctgtattattgtacttaacaacctgcattatgaagtccttgtgtaagcagaacagatctgcccattcaatggcagatgctcctcaaagacagttatcagaagtcactcagtaactctaaggccgtcttcagtatttgtaggtctgcaaatggcatgggcaagaataaaagccagtggtaatagtaacaacgtgccccacagaattttatctgggtcacatacatgcactcctcttgctcctgtgtgtaactttggactttccctcagattctatctggcctgattgcaaggatcttttaacgtgattatccattctggagtttgtccttgattaccttgacaatggctcctagctctacccttactacagtgtgctcctcggttatacattatctcagttatcatagggtcagctcacctttttggccttgtaaagataacagtgctttaaatttttggtttattaatttattcatgaacatttagtaagtcccatattatactaatcattgaagacataaagccaagtagaacaggttccttgcctccaattatcttgcttctctgagaacggaaggtaagagtcaggctgcatctatcaggcatctaactactatggtctttttgacccatttgtactgaaatgttttaaaccagatacaccaacacagttctctagttcctcagcctccagaccaagagagaatatgtttccttgtgaatgctgatcatactttgctaataatgaatgtgtgtttaaagttaaaaaagaataaaggaacacagctggatgtattagtatgggctcatgaaagagacatatccttggatgctgaacccgcatagtcctgttacttcatggatgacacaatgaactgaatctaagacacttctaaaccatcccagcctgcactagagcattggcaaactggaggtgctgttttacaaaatgaatatatgaatggatgaatggtggatggacgaatggatgctttttcaatggcctatatgttcttccaaatattttgaccattaaaagaatttaaagtctagtttgaatttcatctatgtcaagaaactatccagtgtccctagtttaaggtgatcattgattccttgaattcacattcaaaccactgaattcaaatagtttattatttaatctgtacctgtataattatgcaattattgtagttatgagtatatggttgctttaataaattagaaatccgttgatatctggaaatacagttgacccttggacaacatgggtttggagtgtatgggtctacttctacattggtttttttcaatcgaacacagacagaaaatattgtattggcagatgtgaaacctgcctataagaaggcctgatttttcatatgcatggcttctgactaggggaaatgatcatgcatagattttggtatatgtggggtcctgaaaccaattccccatatctacatagggatgactgtatatcttatactgatgccctgccatggactatcatcctgcctggcagggaacagtcactgaataaataatctgtacatgagtgtacttcctaatagataatcttggatcatccatctatgttcagtcaatatgtagaaaagatcagcatattattcatgacatattaaatacacacttattgagtacttattctgggcttggcaaggatgtggttaaaatttaatcaccttaacacttgctcaatgtgtgaataatatgactctaccaaatcatattgttatcttttatcttgttattttataaacagagatataagtaatgacctcaaaatgactttttgaaagaataaattagcatctaataaacaaatacacagctttaaaaatcatcttgttgcaaggaaaggaaacagaacaaagtattttcataatcaagtacaaagttaagaactagagtggcattttttttttattatactttaagttttagggtacatgtgcacattgtgcaggttagttacatatgtatacatgtgccatgctggtgcgctgcacccactaactcgtcatctagcattaggtatatctcccaatgctatccctctcccctccccccaccccaccacagtccccagagtgtgatattccccttcctgtgtccatgtgatctcattgttcaattcccacctatgagtgagaatatgcggtgtttggttttttgtacttgcgatagtttactgagaatgatgatttccaatttcatccatgtccctacaaacgacatgaactcatcattttttatggctgcatagtattccgtggtgtatatgcgccatattttcttaatccagtctatcgttgttggacatttgggttggttccaagtctttgctatggtgaataatgccgcaataaacatacgtgtgcatgtgtctttatagcagcatgatttatagtcatttgggtatatacccagtaatgggatggctgggtcaaatggtacttctagttctaaatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggctagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctgcatattagccctttgtcagatgagtaggttgtgaaaattttctcccattttgtgggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttgagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtagcagtaccatgctgttttggttactgtagccttgtagtatagtttgaagtcaggtagcgtgatgcctccagctttgttcttttggcttaggattgacttggcgatgcgggctctttttcggttccatatgaactttaaagtagttttttccaattctgtgaagaaagtcattggtagcttgatggggatggcattgaatctgtaaattaccttgggcagtatggccattttcaccgtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagacaattttagaccaatatccttgatgaacattgatgcaaaaatcctcaataaaatactggcaaaccgaatccagcagcacatcaaaaagcttatccaccatgatcaagttggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctctataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtcactgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaatagagtggcatttaaagttctaacagaatatagagaaagggcccagggaattgactcacacttatgctatgtaggaaaaggagtgcatcatataatacttatttcatagggtgaatatgtgtgtgtacatatatatatgtatgtatgtatgtgtttgtgtatatatgtatcataggaaagagcattttcacatgtaagcaactttgcaaacagggaaacagaggcaaacagaaaatgcatgtttcctaactgtcaaagcaagcaaaggtcaagtcttctctcaaaccctgtttcaactctattcagtccattgttacttcaaaaccattttaatatttttcattatataaaagctgttcctctatgaaattaatgaaagtaatgatttttgcattaaaaaaaaacagttgtttatccagaataaaaacaaaatccctgagacaaatggggagactcaggaattttccctttttttaatccaagcaagccaaggaagccccagtatacatacatatagcatgtatatatttaactgatcatctataggaaaatacatacattcaattaaaataaatactatactataggtatgtggtaaagaccaatttaatggagcaaaattccatcagaaagtttgctcaagttttagtttttcccaaagcatttgaatcacagaggctacttttttaaatatcaaaacaaatactttgggcttattgtgtagacagacaagttatcatggtgcatatacctctctttacagctactccctattcagaacatcagaataaagacagaaagaagactgcaaatacagcttcagtttgatttcatactgaaatacccactataggtcctctatagtaggctggttgtactggcaaaacaaaacaaaaattattattatcacattcgttcaatacttaatatgtaccagtcaatgttctaggatttttgtacatgcaatttccttgatgatctcagaactctatcaagttggtagataaagaacctgagtctaagtcacatgcccaaggctggctatacagctcatgaatgaaaggtcagaattcaaacatcttctgtttgactttgagatctttttcttgatcaccatattacaatgcatctactattcataataatatctattatcccacttagatgagaaaactgaggctcaaagctcagtatcctgtcagaagtttttcttctatggagtcatccactgaaaattaaatcaggttcaaaattattaattcagtttctccttcaaatcacccttccaaattacactctgccactaataattgggcagattgggacacccttgtgaagtcactattctttgttatttatcatttatattcaacttatttccttgattataaaaagaataatatgttgaaaccaataaaaacatatgtttcattcctacagtaatcaagaaaaagtggatctggttggaaaaagcattaaaaaaagccccgagttatttttggcccatacagcatccccagtacacgttctccctgtggacacagagcagcatatggctgttcttttcacagttcaggctcttctgtttactctgaacctctaggttacaatatgttttgtaatcactaataaggaccacctgtctcttgagagattctgcctaataaaatagagagactcattgttcaaatccactctcaggtagacaatacatgcctcatgtgtgggccgagattactgagtagaaaacttaaacaaattatgctgattgtaattgccaaattaagaacatatgttagtttcataaaaagaaaaaagaaacagtaatgtttggaacaataaagataatgcttttgaggaaatgaaatacctaatatattttccaggaaaaagaaaaagaataatctacttatttaaaaaattcgttcaatccactaagagatattcaaggcaaatttactgcattccaatatgcctaaccatataccctctttgtacaaatttatactatggttgaattcagccagaaaaactggctctttgaaaacaagcagagttcaatccaataactgactgataaatgcttaccactgagaatgtgaaagctatcataaatctggtttaatagaacaagaagagatacagtatatggataagagtaaatcctcctgtcagtatcctcctttggccacagtgacaattcccaccagaggtcaggccagattagcaacctctctctaggctgccattgcaaacccatatatatataccttcatcagtgcacctgctccattgcgctagagtggttggtccgagtgtttgtctctccttctaatctgtgagttccctgagaacagggttcacatattcactatagtctcaacaccttttaacagagtatgagcacagactgaatttcccaaatctattcaaaaaataactgcctaggtgatgatatctattcacatggtagcacaggaaaataaatttatctcatataaagtttgttttttgagtgcagagggattttccaagtattaaggccaatgtcaaagacaggcagaaaggactggctgtggggacagtcagcattttaaatgcagagactgtctctgaactttctcacacaaactcaagtccctcttctaatgggaccttcgctttgcccagtagactcattatctatcaggtgtctcactgaccacatagaatattgagatactgaattaatcataagtaacatttatagatctcaggtgtaccaaacactgggcaaagggctttgttgtattacttcatttaatgcttattacaaccatataaggtgggtgctactgttttcattttagacatgataaaactgaggcaaataatttgtttagtgctttgccatagatctaagcaaaacattaacaagttggtagcttgccaagcactctactactccaccttcaagcaggtgactaatccaactcctaaggataaaagtcatttgatttgtcctgataatcctcagaattcaattcttaatttataacctctctccacagtgcaatttattgttttttcttctaagagatgcattttccatttcggtaaaacccgcaacgctatctagttataaatgatcataatcatgcatgagaaataattctcacaaattgttttgatacattttatgaacgataatacagtcataaacataaaactttcatgcactgttaaatgtacataaaagagcagcttgagattcaataggaagtttataactacattatgcgtatatggcgagatgtgtatatatgtgtacttgtgtgtaaaattatgttatgtaatggtgttgtatgttagtgtatatatttctcaaacactggattttgctgtgtaaatccctaatcatcagaatatattaatgataggcagtccgacattaataaaagtcagataaaaagctttcctatcttagaccttgtcaaaacatttctgtcttatttcatttcctataggtcctctttcaaaagggcttctgtcaaaaagctattgattatcaataacctgtggcattatcaaagttgtgtttcaataaatgtcaatatggattgcagaacaatggataagatttcatgaagcacctagaagtagtaaagtattgatatgtggccttacgtatcactacaatagttagaaacataagctgtctgtgcattattaaatgcatagctgcaataattatgaggaagaaaataaatcataatctccctagttttgtaatttctcatcgtctaattttctgagaacttgggtgactggtgctgcatagacatatcactttgggggacatatttggaaatacaaaacaaaaaaaaattgattaaaaatatcaaattgatgtcttctgattaggttcaaacatgagaaagcatgtatacactctcacagtattatggtagctctgagaatcaagaagaggagatgttttttgctagaggaaagagtgaattacacattaaaacaacagaacagaagaagaatattttcctagtttatttgaagcattttaaaaacatcctactgtctaccgttctttttttatgtatttttattattattattatactttaagttttagggtacatgtgcacaatgtgaaggttagttacatatgtatacacgtgccatgctagtgcgctgcacccactaactcgtcatctagcattaggtatatcacccaatgctatccctcccccctccccccaccccacaacagtccccagactgtgatgttccccttcctgtgtccatgtctactgttcttgtagttatttcctggccaccaaatttctgtgaaaagtcctacttttctgtggaagagatgctggatgaatgaactctaaacctcgactgagactacagaacgtgctccatacttctctatacttaaaaaagccagtgtgcactaatatggggcaaagggctgttaaaatgtgaaataattcttcacctggtggtaagtagatgctgccctccttgccctccccaccccagcatccacagccctgtgcactgatttcctgggcctcccttatccatcaagttcagaattggtttcctgttccagagccccttaggactgaagagtgatggtacctagcagctctccccaaatcccccaaagacctctgccctaagagagctcctctgagggagtgcccaccagcctgagacacctgatgaagttcctcctccgtactgccatccccacgtgctaaccccactgggtacccatcagactccagccgaaagaaacagaactctgggtgatggtgcggcacctggcaggcaaatgcccaggtgcttttgggcaccaatcccaggccttgggaacttgcttccggctgggctcttcaagtcgccctcacatggccacttgtggaaactgcagaattaatggacactggacctgaagagtgcctgcggtagacaaaaatagcaggtagctctaaaggctgttaagtaatctgaacatcacccttagatacatcaaccttccctggtgttgcaactgaaagaggcaatataaacacagagtatgattcacttctatcaaccagatatagccagaaggtctccccttgtgatgtggcaaaagtgatgtgccctttttttttttttttttttcttgagacggagtctcgctctgacgcccaggctagagtgcagtggcgcgacctcggctcactgcaagctccgcctcccgggttcacgccattctcctgcctcagcctcccaaatagctgggactacaagcacccaccaccacccctggctaattttttttgtatttttagtagagatggggtttcaccttgttagccagatgtgacctttttttaagcccaaatttataaatgagggcatattcagtcgattccacaccacctccaacacacagacatacaaaaaatgtacaaagattacaacaaatgactctttcataaaagggcaaaatttatctaagggtatagtcaactgcaggaaaaaaatcagatcattcattaaattcttacagatatcaggagatttctctaaagaggctgaagaatgtccataacatttttaaattgaagagagaatcaagtcatacattttctaagagtttatttatggggaaaacctattctagcaaaagttatacacttaaaaataaagcatccctcctggagagctatatacattaatatatgtttatgacgatacttgcttttagatgaagctgattggtccagtggccgatgactttgtactctgtgcttttgttggttatttgatactggaagatatcataacgtccaggagcatctccgttttcattaaaagtgacaggagtgccagcactgcctataaagatttagaaaacaatgttaataaagttttagtaagatagcccactgggtttatttttcttttagaaggaatggtagataaaaatatattgtgtgaagtaagtgatgcaaagattgcaatccatacaaggtcattcttgatagcataatatcttttacatgaaaaagaagcccagacatacacacacgagtaagacgtgctttattgtacatattagaaagtaaatgatgagtatccaagttaagcaatgcacataacagctaaataaataaaagttgataggctgaatattcaatactggctacatagtatgatagttaatagagaaaaatgtaaatgttttgaagcatgacagctattgtacaatacgaactacaaacagcaattcaaaatatggcaggagaactttctggccagaatcctgagttttgctttttccaaactctctaaagcagttagagagcaccgttcctgtgcctctgctacctctgcccaagagtatatcaatgtggtctactgttgggaacctctcaatgggtgaggcattgatctatgggaagtcccaactctgcccagatcatgattgttctcccccttcacagtgacaggtctaacagtggcagagcagcagggtgcaagaactgtagtcttttctaaactccattcctctcggaagttttcatcttttctcttaatagtttctgctcacttttattttccctcttattaacttttatgtaattacaggggaagagtagaaatggatcaccaccccaatgtcttcttgttccatctagcttcactatctatacagactttccttttctctaacagcttttaggcttctctacatttttttattattattattctttcctgtcttgaaaaattcacctgacaccaatcccttttcttggtgtctgtcttccctctgcaggccttttatctgactctcttctcacaggatattggatttaatttctaaactgtgctagagggtttccccttcttgttatctctgtctcatactgtattctccaaaagtatacataactaatagttatatacgtcaactgtacatattcccatcttataatgagcttcttattctatctgtagagttgtttacctaattaccagccatcacaaaattgtaaaatatttaacttatcaaacaaatcgatgactttatcaaaaaaacacagtaacctgtaaataaatgtaatcagagtcacataacaacaatgtgaatacttttccagtaattaatggacagatgtctaatattctgttttcttgattcttcctaaaaatctaaacatggtgtaagttctctgatgagactacagacatctggtatcatcaggaactgctgaggctgcaagagatggcaccgcatggaagaaagagctctgctcccggaactggaagttccatgtccaggctcactccattccccattgatttccacaacttgtgtatgtcccttttccttcacttaccacacagacttaacaataaatatgaataaattttgaagtcctaaaagagctgtaaatatgtacattattattactattattattaattcacatgagaaatgactttatatataaattgatagatgtacattactcagggaataaaataagagctctccaatcaagcagtactatcttagctactccttatatatggaagtagaacctatttgccaaacctgaccaaaacctttctcagctcctagtgacctcgagcaggttaacctcttaaatcctcagtttcttcacctgtaaaatgggagtaataatgatacttttctcatagagttgttgtgagaattaaataatcaacacttgtcaagtgcttagaacagtgcatggggataaattattcactgcacatttactttcagtacacaccaacacatagtaatagaaaggatgttgaaagttctctaagtgatggctagacaaaagattattgaaattcaaatgaggaagatatttctggctggaaaaacacgtatgttgagaatttcacattaacatgatcaacttctgacatttatatatcactttgaaatattttaattacatattctctcctcaataaagggatacttaattttctctacttaaaatctcccaagttgtcaactccttgactcaatgactccttatcttctacaacagcagttcccaatcttttttacaataacagtacctaagatgaaataatgtaatttgtataacacattaccatgaatataccctaagttatacataattcctaatgtgttagctgtttctatatccaagtcaagaaagcctctcaagagagctcattagagagccacattgtcacaaaatataataatttccaacttagatactttgaatatcattattaaaatcaagttacactaaatttgacattgtattaaggtgcaatattctaaagcagttataagtgtgggttctggagacagatcattgggttcaaacgcccctctgtcacttattgatgtggtgtcttgaatgcatttcttaatttccctatatctcacatttctcagttatatagtgggctaatagcaattcccacctcagagggatatataaggattaaatgaatcaatatatataaaacatttagtacatcatattacgtattaactataatttcttttgttgttttgtggaaatgttgtgtttgagagccactgtctatatgagaacatataaactcagtgagcgtataagttttcctgatgtcactctcactaatctctgatctctttcaacacaatgccacctatacctaaaattccggtccctaaattcattatgctctgtctcaccattctgtctttgctcaggctattttctctaatttcccattctctttcctccttacccctctctatataattccttcaagatgaggctcaagggtcatgcacttacagaagcttaatcttactccaaccctggggaaggtgcccaaccacctctttatgtcctaacatgcaatatcgaagcactcgcaacattccacagacttactatccattctgtacctgaccaaacatttattgcacagatacttttttagagcctattatgtgctcaacactgggtggaccctctgcaatcttcacaaaactatggtcttcttaagaaaggcaaaagtatctattatctttgtaagcactgcagcaaagacagtgttcagtactgagcaagtaatcaataaattataggaaagcatgaaagaggcatcccctaatgatcccaagcaaatccatgcttccctcttcatgacattatgaacttcatgtatattttctgtcatcttttatattcacaaacggagagaccaaataaatcctctcactttgttattaatgtgacattagaaaccacggggaaactttgacatatctgtgaatgggctctgagttaatcaccagtagctgaagtggtttttattactgatgacccttgcatcttgttttcctaatgcgatttctagtcttaaattaggcttgcagttgaattacttcaaccctttttcaggaagaactgattccattacatattgactcatttcaaatgactgccatggaactctggtcaatgtagaaagagcatcgttgagtagccataaggaactaactcattagctgtttaataattcctacaagtttgccatcttttaaaaatgtcattgtttgtactgaaactggccactctgagaaacagaattaagtggcgaattttttttttgtccacaaaaaaatttcaaatgacaaatgtctgttaatatagtcattaatttatcaaggtttaataacaacacaggtaagaaatataactttgacagagtggggttccaagatggccaaataagaacagctccagtctacagctcccagtgtgagcgacgcagaagacgggtgatttctgcatttccaactgaggtaccaggttcatctcactggggcttgtcggacagtgtggacaggacagtgggtgcagcccaccgagtgtgagccaaagcagggcgaggcatcgcctcacccggaaagtgcaaggggtcagggaattccctttcctagccaagggaatgggtgacagacggcacctggaaaatcaggtcactcccaccttaatactgcgcttttccaacggtcttagcaaacggcacaccaggagattatatcccacacctggctcagagggtcccatgcccacggagcctcactcattgctagcacagcagactgagatccaactgcaaggcagcagcgaggctgggggaggggcacacgccattgctgaggcttgagtaggtaaacaaagcagcccggattccctcaaactgggtggaacctactgcagctcaaggaggtctgcctgcctctgtagactccacctctgggggcagggcatagccaaacaaaaggcagcagacctctgcagacttaaatgtccctgtctgacagctttgaagagagtagtggttctcccagcacggagtttgagatctgagaacggacagactgccttctcaagtaggtccctgacctccaagtagcctaactgggaggcacctcccagtaggggcagactaacacctcacacggccgggtacccttctgagacgaaacttccagaggaacggtcaggcagcatcgtttgctgttcagcaatattcactactctgcagcctccactgctgatacccaagcaaacagggtctggagtggacctccagcaaactccaacagacctgcagctgagggtcctgactgttagaaggaaactaacagacagaaaggacatccacaccaaaaccacatctgtacatcaccatcatcaaagaccaaaggcagataaaaaccacaaagatggggaaaaaacagagctgaaaagctgaaaattctaaaaatcagagcacctctccccctccaaaggaacgcagctcctcaccagcaatggaacaaagctggatggagaatgactttgacaagctgagagaaggcttcagatgatcaaacttctctgagctaaaggaggaagttcgaacccaatgcaaagaagttaaaaaccttgaaaaaagattagacaaatggctaactagaataaccagtgtagagaagtccttaaatgacctgatggagctgaaaactatggcacgagaaatacgtgatgaatgcacaagcttcagtagctgatttgatcaactggaagaaagggtatcagtgattgaagatcaaatgaatgcaatgaagcgagaacagaagtttagagaaaaaagagtaaaaaggaaagaacaaagcctctaagaaatacgggactatgtgaaaagaccaaatctacgtctgattggtgtacctgaaagtgacagggagaatggaaccaagttggaaaacactctgcaggatattatccaggagaacttccccaacctagcaaggcaggacaacattcaaattcaggaaatacagagaacaccacaaagatactcctcgagaagagcaactccaagacacataattgtcagattcaccaaagttgaaatgagggaaaaaatgttaagggcagccagagagaaatgtagggttacccacaaagggaaaccaattagactaatagcagatctctcggcagaaactctacaagccagaagagagtgggggccaatattcaacattcttaaagaaaagaattttcaacccagaatttcatatccagccaaactaagcttcataagtgaaggagaaataaaatcctttagagacaagcaaatgctgagagattttgtcaccaccaggcctgccctacaagagctcctgaaggaagcactaaacatggaaaggaacaaccagtaccagccactgcaaaaacatgccaaattgtaaagaccatcaaggctaggaagaaacagcatcaactattaagcaaaataaccagctaacatcataatgacaggatcaaattcacatataacaatattaaccttaaatataaatgggctaaatgctccaattaaaagacacagactggcaaattggataaagagtcaagactgatcagagtgctgtattcaggagacccatctcacgtgcagagacacacataggctcaaaataaagggatggaggaagatctaccaagcaaatggaaaacaaaaaaaggcgggggttgcaatcctagtctctgatgaaacagactttaaaccaacaaagatcaaaagagacaaagaaggccattacataatggtaaagggatcaattcaacaagaagagctaactatcttaaatatatatgcacccaatacaggagcacccagattcataaagcaagtacttagagacctacaaagagacttagactcccacacaataataatgggagactttaacaccccactgtcaacattagacagatcaacgagacagaaagttaacaaggatatccaggaattgaactcagctctgcacaaagcagacctaatagacatctacagaactctccaccccaaatcaacagaatatacattcttctcagcaccacatcacacttattccaaaattgaccacatacttggaagtaaagcactcctcagcaaatgtaaaagaacagaaattataacaaactatctctcagaccacagtgcaatcaaactacaactcaggattaagaatctcactcaaaactgctcaactacatggaaactgaacaacctgctcctgaatgactactgggtacataacgaaatgaagtcagaaataaagacgttctttgaaaccaatgagaacaaagacacaacataacagaatctctgggacacatttaaagcagtgtgtagagggaaatttatagcacgaaatgcccacaagagaaagcaggacagatctaaaatcgacaccctaacatcacaattaaaagaactagagaagcaagagcaaacacattcaaaagctagcagaaggcaagaaataactaagatcagagcagaactgaaggagatagagacacaaaaaaactcttcaaaaaatcaatgaatccaggagctggtttttgaaaagatcaacaaaattgatagaccgctagcaagactaataaagaagaaaagagggaagaatcaaataaacgcaataaaaaatgataaaggggatatcaccaccaatcccacagaaatacaaactaccatcagagaatactataaacaccactgcggaaataaactagaaaatctagaagaaatggaaaaattcctcgacacatacaccctcccaagactaaaccaagaagaacttgaatccctgaacagaccaataacaggctctgaaattgaggcaataattaatagcctaccaaccaaaaaaagtccaggaccagacggattcagagccaaattctaccagaggtacaatgaggagctggtaccattccttctgaaaatattccaatcaatagaaaaagagggaatcctccctaactcattttatgaggccagcattatcctgataccaaagcctggcagagacacaaccaaaaaagacaattttagaccaatatccctgatgaacatcgctgtgaaaattctcaataaaatactggcaaaccaaatccagaagcacatcaaaaagtttatccaccatgatcaagttggcttcatcccagggatgcaaggctggttcaacatacgaaaatcaataaacgtaatccagcatataaacagaaccaaagacaaaagccacatgattatctcaatagatgaagaaaaggcctttgacaaaattcatctgcctttcatgctaaaaactctcagtaaattaggtattgatgggatgtatctcaaaataataagagctatttatgacaaacccacagccaatatcatactgaatgggcaaaaactggaagcattccctttgaaaactggcacaagacagagatgccctctctcaccactcctatgcaacatagtgttggaagttctggccagggcaatcaggcaggagaaagaaataaagggtattcaattaggaaaagaggaagtcaaattgtccctgtttgcagatgacatgattgtatatttagaaaaccccactgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccatttacaattgcttcaaagagaataaaatacctaggaatccaacttacaagggatgtgaaggaactcttcaaggagaactacaaaccactgctcaacaaaataaaagaggatacaaacaaatggaagaacattccatcctcatggatgggaagaaaatatcatgaaaatggccatactgcccaaggtaatttatagattcaatgccatccccatcaagctaccaatgactttcttcacagaattggaaaaaactactttaaggttaatatggaaccaaaaatagagccctcattgccaagacaatcctaagccaaaagaacaaagctggaggcatcacgctacctgacttcaaattatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctcaaactggatcccttccttacaccttatacaaaaattaattcaagatggattaaagacttaaatgttagacctaaaaccataaaaaccctagaagaaaacctgggcaataccattcacgacataggcatgggcatggacttcatgtctaaaacaccaaaagcaatggcaacaaaagtcaaaattgacaaatgggatctaattaaactaaggagcttctacacagcgaaagaaactaccatcagagtgaacaggcaacctacagaaggggagaaaatttttaccatctactcatctgacaaagggctaatatccacaatctacaaagaactcaaacaaatttacaagaaaaaaacaaccccatcaacaagtgcgcaaaggatatgaacagacacttctcaaaagaagacatttatgcagccaacagacacatgaaaaaatgctcatcatcactggccatcagagaaatgcaaatcaaaaccacaatgagataccatctgacaccagttagaatggcgatcattaaaaagtcaggaaacaacaggtgatggagaggatgtggagaaacaggaacacttttacactgttgttgggactgtaaactagttcaaccattgtggaagacagtgtggtgattcctcaaggatctagaactagaaacaccatttgacccagccatcccattactgggtatatacccaaaggattataaattatgctgctataaaggcacttgcacacgtatgtttattgcggcactattcacagtagcaaagacttggaactaacccaaatgtccatcagtgatagactggattaagaaaatgtggcacatatacaccacggagtactatgcagtcataaaaaatgatgagttcatgtcctttgtagggacatggatgaagctggaaatcatcgttctcagcaaactaccccaagaacaaaaaaccaaacaccgcatgttctcactcacaggtgggaattgaacagtgagaacacatggacacaggaaggggaacatcacacactggggcctgttgtggggtgagggaagtggggagggaaagcattaagagatataccgacaagttaatgggtacagcacaccaacatggcacatgtatacacatgtaacaaacctgcacgttgtgcacatgtaccctagaacttaaagtataataagaaaaaaggaaaaaaaagaaatgctatttacattaaaaaaagaaatataacaaatatatttgattaagcaatattcacacatattttacatgataaattatgctcacattttcctgttttatttctctccatcctatacgttaggtatttcagaaattttgatgtgtattaattttgtttttgaggagggtggtggaaagggtctccctctgtcactcaggctggaactcggtggtgtcatcttggctcactgcaacatctgcctcctaggatcgagggatcctccaaccttggcctcctgagtagctgggatcacaggcctgtgccaccatgcccagctaatttttgtaatttttggtagacatagggttttgcatgctgcccaggctggtcttgaactcctggggtcaagcaatcctccctccttggcctcccaaaatgccagaattacaggcatgaataaatgtgcccagccaaaagtggattaattttttaaaatggttttcacactgggtgcagtggctcatactttgggaatctgaggtaggaggatctcttcaggccaggagttcaagaccagcctgggcaacacagtgagacccccatctctaccaaaagataaattagccaggcatggtggcatgcacctgtactcctcattactcaggaggctggggtagaaacatcgcttgagaccaggagcttgaggttacagtgaactagaattgcgctactgcactccaactccaggtgacagagcaagatgctgtcttaaaacaaacttttccatccacatgtgctagtgcagaaatggaaacaaacaacatggagttgtgaggtaatgtttactcatcaggtgctacccttagatgtcacacatctccttgaatattttctgttcaataagaaatgtgtgaaaaagtatatttttattcgtaggcatctcaagcactccaacatggttttgtagggaaaatgatatattcaatgaaggttttttttttcaaatgttggctcttttgaatattgcgcaggggaagaatatgggcttgggatgcagggactagagtctgctttctggctctaccaattatccgtgtgatctgagtaagttaccctccttaagcctgttttctcatctgccaagcaggcataataaccccaaccttcctaaactgttgcatgagatgacagtgtatatgactggtacacaatagatgtgcaatgaacgcaaacactcatcatcttccattcctttggctgcacttatgcccccttagtatacattttcttgtttacaccatgcaaaacacaatgtaaaaataatgcattcacctttatgtgcaaaaattatacatctctttgttagtgcaatcctctcagttttttgtcaagtttattcttccctgctcccctcatgctaccaaaaccttattttcctgatcatcactgcctaaactattggaaaagcaggaaaaaaataagaaagctagaaatgaaatgggttaatttagtaatttttagcacccttaaataaagaataaatatgtgagatttgtcattgaccaaaatgccataggaagtagcaattttcaacagtgtctcaattattcatgctctctttccttatccaatttactttactaagtatttattacacttaaatagattcacatatttgaattaaaatcatatagttttattatttaggaacttgattactcttacatgtatcaattactcaccccagttctctgaagcctttagcatgtgacttactgtattctcctccaaccacatttctgttatctctttggtggtagtataatttactcaacactcaacatcctggctgcagagttagacttacttatttccaattaccttttttgtttgtttgtttgtctgtttgtttgatttgagatgaagtcttgtctctgtcctccaggctggagtgaagtggctccatctcggctcactgcaacctccgcctcccaggttcaagtgattctcctgtctaagcttcctgagtagctgggattacaggcatgtgccaccatgcctggccaatttttgtagttttagtagagacagggtttcaccatgttggcaaggctggtctttaactcctgacctcaggtgatccacccacctctgcctcccaaagtgctgggattacaggtgtgagacatcatgcctggccccaatcaccatttaaaaaaaaaaaatcattcacgcatcttgacacatactatcatagtcactctctggaaattgtcttgtctagtaaccatatcatctccaaaagtttcctctttggacaccaccttccatcctcactgcaacaattctatgatttcctacacttcccaattcattaatcaccctgttttgtcacactgcttcgctcccatgatagtgactcttctctcctattcctagacatgttctatgatctttctagggaataccctctattctcttgcgcttctctctgtccagtgaattgctctatcaaaatcacagtcattgtacaattaaattcaattgtacatcttctttgcctgcacccaagaagctgaacattgtttaataaaatgataaaattttattgtctgacaagaccaggactaggctgaggcaaatgagatgcccagggcatgactccgagagggaatctatctccctgaattttgcatgctaggtgcctcacttcctttaccttgtccctgctgtctggtcttactttaaattcataccctcagatttcacatggacaatcagcattgctctgcaatcctatcacactttcccagttggcccatttccccctcgcttctaggtaatatttgactgtttcatgacttattctcatccctcacatatccaacaccttccttcccctgtcattccggcttgcttcatacgtttccactgagaaaagacagcaatacaaaaacttcctcatcattccaccacaaaatctaccgcctacctgtatccacactcatattctcccatccctcctgatgcaacacatatcccaggtccaatcaaaggaatgtcctcccttggtgctggggccccatcactctcaccttccatgcactttcagttcagttatcttttctttcttttacataaacaaatttagacttttggcagaagtatccccatcaatttacaaatcagttctaatagctctcaagaagaaagcaactaaaatccgttactctatccccacagactcattcagctactgcttcatttttcactcccttcatggtaaaattgtgttcattttctccactttcttatttctcttttactctttgacacattttaagttaaaatttaacctcattcctccactgatgagtctcaaatttatatgtctagccctgaatgcagacttttccaattatctgtatctccacgttattgtttgataattatctcagacacaatgcttgattcttacatatttccaaacatgttcttcagacagtcatctccgcttagtaagcagcttactgtccaaccattcaatcaattcaaaacctaatttaatacccacatctatagcaacacacaggactaaatcttaatgtaaactaagttaataatgatgtatcatactgatccattagctttcatacatgtaccacattcatacaagatgttaacggttgggggagctatgtgtgtgtggaggggtgtaatatagaaattgtgctctatgttcagattttttgtaaatgtaaattattttcttaaaaagtctaaatttttttaatggtgacattaattttaatatactttatgtaaactaacatatgaaaaatatcacatcaaaatataatcaatatagaaatattgaggtactttatgcacttatttcctaagtcttcaaaatcttatgtatactttatactacagcttatcacaattcagattagccctgtttcaactgctcaacacccacatggttagtgctgaccagattaaaacaacacaggtctaaaaggcagataatttcagcagccactgctccctcgctccaacactccattcactggggatgaaggcccactgctgagcctttctcatctggcctcctcttcaactggactgaaccccccttcaatcatttcttccctaaatgtatgtggaccaaccaaagactgacgtatggctcagtggatgccagatctggagaccagatcctaaaataaaatctaaacttctccagaggtaaaaataaacaaggcccatatctaggccaggcatggtggcatacacctgtaattccagccacttaagaggctgagttgggaggatggcttgagcccgggaggtggaagctgcagtgagctgtgatagcaccactgcactccagcctgggtgacagagagagaacctgtccccaccccctgctcaaaaaagcttacatctaatgcatggacaggttctatcttcagaacgtatctagaatttgcccattctttttaccccctcttgcattaaccttgtcttggctactataacctctccctgaactcttagcaggtatcctgcattcacactgaacaacaacaatccactctctaccctacagtcagaatgtcaatgaaacacaaatcaaataatatccctcttcttgatatccttcaatggcttcccatttcacttagaataaaactcaaaggcttatcatggcctttaagtctcttatttatctgatcttgctcattttctgtactccttccaacctggtcttctttctgtttgcaagcacatgaaggttgctctctctcagggattttctgttttctcttcccagtgttcttcccgacttgatcttctgactggcttctttcattactcgtatcccacccaaaatatcaagagaggcttgtcggatcaccatatctaatttagcctgatttctatccctgtcattcactattacacacattattgccttcatagtacttttaaatatctaaaaatatttggtttgtttaactgatcgatataaatcgctggatgatatgcctgtgattgtggaaaatatttctatcacattctccaccatatatatagctcagactattggatgaggatccaaataaatattatctttttcctgggcacatagctaggctacccttttccagtcttccttgcacttaggcatggccaaattattagttcagacaatcaattgtgagcacacgtgatatgcactacataggagggcattaaaaccccctaagtggtcttctatggtcttttctcttcctagctggctagaatgaaaatgttatgctggacactttgagcatctgcatgttaaaaacgacagaacttacattaggctggattccagcgtgagtgcatgaatatccgtgctactaacctgttaatccaccattcctttagcataattgtgtgagtataaaacaaacttctattctgtttgagtcattacaggttgtcagtctatttcttccagcagacacccataacatccaaatatctagtgagttctcaatgaatagttattaaatgaataagtgaaatcatattaagtctggaaataaatgtttcacttcatgtcacattataaagcttcaagaatagtgtagagtgagtatcagacactggcatggattaataacttgtttcagattgtccttaagagttaatactcattacttcaatgtggatatatataatataaggtggacttgagaaagtgtaatcattcttcagaattgcactggataagtatccatgtttatttaccttggctaaaatacacaattcgtttccataaaaaccaaatatagaagtattaaaaatgtgtgcccaattttaggttgaaaatggctttaactgttttggtgtgttaaaaaaaaaaagacacgacaagaaatgtagttgaatagcatttctaattctctgaaccaactcttcttcttgatctatcaaaaaactgagataacagtaatttctcctgtggaaatgtcttcatgatccttggataaaatgtgctttaaggttgcaaagtgtcattgtcattaatgaatagcactatttgagaaacagaaatagaccctataattgcatttatagtactcaaataagctgattcaacttttaaaataggaaaagacccattattctgtgatatgcatctcagggaagcagatgaattaggaggtttaaataaaatctcttgtaagaaaagtaaccacagagactattaaaatatcaaatgtttggctaaaggaaataaataaaaaagaacatataataattaggcaagattaggtaatatatcttaaaatgaatgtgagaacaaaccaaaatacgttacaataccctgaatctaatatattttcattctgtaacagaaatcctcttttcatcttatgtacttgaagccctttattattttttctggggtacattaaatactttacatataaaaatgtgtatatatgacttccattataaaaaggactttgctttattaatcattgtatctctaatagtgatgattacatatatgagagaagtgtgtgtgtgtgtgtgtgtgtgtgtgtgtacatatggtccaaccttttcaaatttgctgtactaggaaaaggtctttcatcaactagtccattgtgttggtggaaaaagaaagattctctttccatctggatttacaagagtcacatttatcagtctttataatgatgctctcatggcttgtataagaatctcttttgtacccccaagtctaaaagttattagtttacattttttactaagagtttttaaattatgctgttgatattttcatttaatatacctgtagttgacatccctaccatagtaggtaagggatatgaggtagaaatacaatttcactttttttctatattggtagccattttttcagttctttttgttgaataataccctatttcctactggctggagcaatgcttctattttatatctaagatctgtaaatggatcttgttctggcctatcctgttgcattcaccatttgtccatccttgacacaataccaatggtcaatataaattactaaagttttataataagacaaagcagtatgacaagtttcctatttttctttcttagaagtgttctaccttctctttgctttatacttctccatataaaatgtagaacaatctggctggcatgttggctcatgcctgtaatcctagcatttggggaggctcaggcaggaggatcgcttgaccccaggagtttgaaaccagcctgggcaacaaagtgagaccttgtctcaattaaaatatttttaaaatgtagaaccgtcttaataatttccatgaacaacactgtatagattatcactggagaatttataaaatctgtaaatcaattgggaaagatttaatatctttatattgtcttcctaaccatgtgtattgcttgcttccattatttagaccttctcttataagtcttaaaacagttatataattttcttttcatagcacctaaccatttttgtacatttattcctagataatattatctgatactattgttaatgtttcttaaactacattatctattactttgctgttagtatacaaaatgcagctaactttttctgtatcagtcttatagctagctcagtggttgaggtgattttgtccctcacaggatatttggcacaatgtctggagatatttttgataatcccaactgggaaggtgatgttattggcaactagtggaagaggtcaaagatgctactaaacatcccacaaggcacaggacagtgtcctacagcagtaaattatccaaaatgtcagtagtttcatgtttcagaaaccgttgcaaattcttttattatacctaataattgatctctagattttttatttctatggaaagcatcaagttttctgcaaatatttatatttttatgtctcccttaacagttcttgtagcttaaatatttttttcttcttttcttattgtactatctaggaccttcagtacaatgctaataagaagtggcaatagtgaacacctttgcattttttttaactttaaaagaatgcctcccatattccccagttagtatcatattcatttaggccttttatgtgcacttttcatcagtttaagaaagtccctcatattctaaatgaactaatatttttattatgaatatattttaaatgttagcaatcttttttcctttaatctgttaccataatgaattatatttctatatttctaaatgttgcattatggaaacatggagtgaacacaacttgatttcaataatttgcatttttattcactattggattcgatctgctaatgttttgtttagaatgtttacattcatacttatgagtgagaaggatctgtaatttttgtttcttataatgttcttcttgtttgggtatcaggttatactgacctcaaagaataaatgggaaagtagtccctctttttcttttctttttttttgttcgagacacagcctcgctctgtcgcccaggctggagtgcagtggcgtgatctcagctcactgcgacctccacctcccaggtagttcaagagattctcctgcctcagcctcctgagtagctgggattacaggcgtgtgccaccatgcccagctaatttttgtatttttagtagagacagggtttcactgtgttgccaggatggtctcgatctcctgatctcgtgaaccgcctacctcagcctcccaaagtgctaggattacaggcgtgagccactgtgcccagcctagtccctcttttcctattgcctgcaaatgtttgagtaaacttgtaataatatctttcttgaaagttttgtatagctcaactggaattgccctaaatgcccacaggatagtgaacaaatcaatcatggtatatggtaaattcatacaatggaatattatactgcagtcaaaatggatgaactacagagatggccacaaatatagataaatctcagcaatatattaaatgaaaaaagtaagtatacaaaatacattttataaatgtgtaacaattacttaaaattttttcattcattttgagaaagatgcaagacaaatgtattttaaaaggcaaaggagtgttgttagttattcaggaggaatgagaatgggttggtaatttaaatacatgtttaaatatagctttttgtcaaaatactagcttttggggacataagagtgttttcatagatgcatattacatttttaaataactaactaaataaatgaaagtcactttgcatggatcaatgataactatgtgtcataagccaaacagccaataaatagaggaaaaaaaagcagaagagggaggaggaggaaaaaaggagaggaagggataatgaaagagtgagggaaggaaatgaaaggtagaaataataaatcaaataacaaacattaaaaaaatggggaaaatccacactaaaactatggaaaagaaaggtatactaaacaacaattctttaactttcgtgtaactctgtgaattaactgactgctacttaggcttgctattgtgcccatggagaatatgaatcctccccggaggtcaatgaacccagacaaaataggtcacatacagaattgcctttacccaattctctaaagcagcttttctgcacatttttagattttacatcagtcaaccttctgtctgttatttccggtttataaactataactgtgtgggattagaatcgcattacatttttaagccaaaaagcttaattcattttttttcactttgtacactttttaaagagtaaaatcaggcagaaagtcacctcttcccagttgagtcattatttcacttcttgttaagtttcaaattgttcttttatcttgggttatgcatgcctttgtaataatttattgtttgaataaggtatagtctttcaatgcatttaacaattaatattttcttaatgtttgcagaattacagtgagccaatcaaatacacaggactttataggaacagatgcctaagtgtctaaagaaataaaaaaaatatcaaactaggagagatctactcatctctgacaataatttatggatttaacttaaaaagatagcagataatttatttataatggacctgattttctgtaattacatgaactgtcaatgaatattaggccactgtgatagatgtgaattgtctatgttactatggtgatttgaggtgtttctattctacactgcacgcataacaatgtggagcataattaaaagacatagtgaaatatattttaaaattgctgtcaattaaaaagcaaaacatagtctgactttagcataatcctttcagaagctggcctatcaaactgatgaaaacaataattattagttaatatattgtcttttcaaatgtatctaaaacatttacaaaaatgattattttctgccaaaatgaaatgctagcaatcatgattttgaaatcttagttcatattctctgaccattatgtgataaaacatgaaattcttaacaaaagccttaaaaaattaaaaagttaacacaacaccaaataagaaaaaaacaatagcctccaaagatttagaacaaaaaactaagcacttattttaattaattagtcaaagaaaaaattaaaattaaaatcatagagtgctatttaacagataacaatatatcaaaatacctaaagaatgtgaccaaggctgtcatcagaggaaaatttagagaataaaaagttttattgaccaggaagaaattgaatccctgactagaccaataacaagtctgaaactgaggcagtaataaataggctaccaaccacaaaaagtccaggaccagacatattagcaactgaattggtatctaccagaggtacaaagaagagctggtaccattcctactgacactattccaaaaaattgaaaaggttggattcctctctaagtcgttaaatgaggccagcatcttcctaataccaaaacctagcagagatacaacaacaaaaaacttcaggccaatatccttgatgaacatcaatggaaaaacgctcaacaaaatactagcaaactgaatccagcagcacacacaaaagtttatccaggatgatcaagtagacttcatccccgagatgcaagggtggttcaacatatacaagtcaacaaatgtgattcatcatgtacacagaactaaagataaaaatcatatgattatctcaatggatgcagaaaaggcctttgataaaattcaacatccttcatgttaaaaactctcaataaactaggtattgaaggaacatgcctcaaaataataagagccatagactacaaacccacacagccaatatcatattgaatgggcaaaagctgaaagcattccccttgaaagctggcacaagacaaggatgccctctcttaccattcctactcaacacagtattagaagttctagccagggcaatcaggcaaaataaaaaaataaagggtattcaaataggaagagaggaagtcaaattatctttgtttgtagatgacatgatcctatatctagcatagaaaaccctataatctgtctaaaagattcttatgttgataaaccactactgcaaagtctcatgatacaaaatcaatgtgcaaaaatcactagcatttctatacaccaacaggcaagccaagagccaaatcatgtatgaactccctttcacaactgccacaaaaataataaaacacctaggaatatagctaacaagggaagtgaaggacctcttcaaggagaactacaaaccactgcccaaagaaatcagagatgacacaaacaaacggaaactcatttcataatcatggataggaagaatcaatatcgtaaaaatggccatactgcccaaagcaatttatagattcaatgctattcccattaaactaccaatgatattcttcacagaatcagaaaaaaactatcttaaaattgatattaaaaacaaaaaaaaactcgcataggcaagacaatcgtaagaaaaaggaacaaacctggaggcatcatgcaacctgacttcaaactatactacaaggctacagtaaccagatagcacggtactggtacaaaaacaggcacgtagaccaatataacgaatagagactcagaaataaaaccacacatttacaaccatcttatctttgacaaacctgacaaaaacaagcaatggcagaaggactcccgatttaataaatggtgctgggagaactggctagccatatgcagaaaattgaaactggatcccttttttacaccttatacaaaaattaactcaagatggattaaagacttaaatgtaaaacccaaaactataaatccctagaagaaaatctaggcaataccattcaggacataggcatgggcaaagattttgtgatgaaatcatcaaaagcaattgcaacaaaaggaaaaattgacaaattggatctaattatactaaagagcttctgcacagcaaacaaaactatcatcagagcaaacagacaacccacagaatgggagaaaatttttgcaatctatccatctgacaaaggtctgatagccagaatctacaagaaacttaagcaaatttataagaaaaaaacaaacaagtccattaataagtgggcaaagaatagaaacagatacttctaaagaaaagacctatgtgcagccaacaaacatatgaaagaaagctcaacatcactgatcattagagaaatgcaaatcaaaaccacaatgagataccacctcatgccagtcagaatggcgactattaaaaagtcaagaaacaacagatgcttgtgaggttgtggaggaacaggaacacttttacactgttggtgggaatgtaaattaatttacccactgtggaagacagtttggcaattcctcaaagatttaaaaccagaaataccatttgacccagcaatcctattattcagtatatacccaaaggaatataaattattctattacaaagatacctgcacacatatgttcactgcaacactattcacaataaaaaagtcatgcaatcaacctaagtacccatcaataagagactggataaagaaaatgtggtacatatacaccatggaatactatgcagccctaaaaaggaacaagataatgtcccttgcagggacatggatggagctggaagccattatcctcagcaaactaatgcaggaacagaatatcaaatactgcatgttcttacttataggtaggagctgaatgatgggcacctatggagacatgggggaacaacacacactggggcctgtcagatggtagaggataggaggagcgagagcatgatatagagacacgtttttttaaagttaagcaccaaaattagattatttttgttagtaaagtgtaaactaatctaatttttcctctttattattttatttcctgtaataatcattttatttttattaaaaatacattaaaaatatttgctttgaatataggaaatatggaagacctggaagaataaaataagaaaagttatattttggtaaacaatacacatcgtatcaatggctaatatatgcaaattttagcagatagaagtagctctcagaatctgctgaccacaatgctttcccccataaagtggagaagaaatgtggaagagcctagttccattaccctggttctgtaaaaaacaaacaaacaaacaaaaaacaaattacagttcaccagtgagtccagttcaagttggccagacttgaactgagaagaacactaataatattcatgtagtttcatctaaaagatgttagtaccagaaaataaaaaggaaatgtgtgtgttcaacaattgatgagcgctagcatcaatgctcctgaagatcttgatgttattcgctcttggtctgtgtctatagatagatataagctacttggagcacttggatgacaaaatctttttgattaaaatgaaaacaattgttgtgctaaaacaaatgatcgaaacagttttcatgacactgatattcttatatcatttaatcttaaatgttgaagacctttaaatagttaaaaacatatctgtttttttgaaaagcactaggaattaaatccatgtccaaaaatacaattttttgtatgttaaaataacctctttcactaaataactatttggtacatatagaatgttcatattaatctatttatatgtaccatataaatattatatgtaccatataaataactatttggtacatatagaatgtaaaaattgaaagaatttaagtccctattttataattaattccatttagttttaatgctaattaagagagaacactctatttctcatatttttagtatatcacaagtatatgaaaaaatgcctattttatcttaaaacagctatgctttcaatgtaattttatagattttattagtatattagttatcttttacagaagataaactacatagaatttagtttaaattaggaataaatttcttggcttcatttaaaaggagaaggaggttattattcatgatcattagaggaaatatcctattgccattttaaagttcttttatatggaaacacactgaattaaaaagtgaaggaattaagattgattagaagtgttttaaagtggcttttagatgtatctgcaaaaataaaaagtcagttctatcccaggccattatcagctgtcttgttaagtgcccctagcattctcatattgaagtcctgcagtgccacataaaataagtcctggggaagatctgaccccaccttgtgaatttctctgggctttgccttatttccccttctcattcatcaactgaatgggtttcctgaccccacaggcaagtgaaacttggtttctcactttccttgtttcctttgcatttcaaaacttagctctagactattcaatctcaatgttatcttaaacccctatagtatctggggtttgctcatattttctactggctgcaagctcaaaattggtgtaccagagcgctttctaacatagcccagtcctccaacacacctagaaacacacctgcctaccttctccccctggccttcctgccttccttcctccccccacctttcagggagattgtacattttcatcatctccactgaaatgattactaatattatcaaatgattattgggtccttatttgcagacgttatgagtatatggaaatataagtctagcctttacttaagacaatacctgagattttagtgattttatctccaaagcagtgatgttaatgtttacttttaatgatgaaatgttaaataatctccatgagggtcatgactagacaaccatccaaagagagaagggtctagcagtagaaagagcagaggctttagactcaaacctgccatcactgtgagatcctgagacaccatccctgtgcgtgttccctcctcttacgggggtgaaagtcacccacatcatagactgggctggagaattaaatgactaaacatttacaaaagtgctatatgttgtcaataattgttagtctccctccctcagtgccatgtctatgaaagtagaataagtcaataattttgttcagcccaataactaattaattcaaaaagctaattttatctttccttgcccattgatttgatcaagagtataaaaaataaacaagttgacatttcattttcttcaacatgaattcccgtttgaaaagagttaatgccttatagctatttatgctcatattggtgactaatatcaactttctgtatttcccactatatttggctaattgaaaaatttatcaactgaatccaactaactctaaaaatatatattaattaagaacattaaactcatacgaccctttactttgagtattgttgccttctgttgaggcctaactttatagagttttaatgcagttatttgttcctgagaataaaattaaaatttgggtacatcacaaaatgtattctttcagaaatataatttttacaccacatgctctgaggagtttttttttaatttctgttatgagtctcatatttttgaactacctctccctaagaactctggtacattactggaattagcatcagtaggcaaaattccctatccaaatgcataacacaggtggcatacctgttctttatcttacttgggagaggaaacctgatcccttgctttgtgctgactgctactcagatcacagacacacttgttaaaggactataatgtgattcagctcaaccattaatttatgagataataaatttaccactttattcaaacaatattagatttcctaaatacacacaagcatttacacatcataaattcaccactaaaaccacaaacattcttgtactagaaagttgatattacaggtaaatggggctggcatttcacatatatgtattttttcaattcataaggggatgttttacacattccaaaatgtctgaaaagaaaataaaaatattctttagaatttttatgaagctatatttttcttcctttgaaattgctaaatgctttatgcattctgatttaaatgccttttggaattgggatttctgaagtttatagatgcatttacctttatgactaaaaatctctcagaaacttatataaaatacatattttgtatttttaaattatgagaacagcataggagaatagtgtatataatatgtaaagttattccctggggtccagagaggcttggtttctaggcctcccatggataccaaaatccaaggacactcaagttcccgatataaaatggcatataacctatgtacatcctcctgtatattttaaattaactctaaattacttatacctaatacaaggtaaatattatgtaaatagctgttccactgtattgtataggtaataatgacaataaaaaagtctgtacatgttcaatacaaatgcaattttttaaaaaatattttccatccatggttttttgaatctacagatgcagaatccatggataccaacgatacaaaagaagattctgcaacccccttttatctgaaggaaaaacaaaatcagagaccatacttctagtttttttttctgtcatctgaaagcttgtaggaattcatctaagtctgtaggttatctcattagttaatttgttcttataccctaactaaattcaaacacaaaataggaatttttataaaaataacaaaagcacagtaattgaaagtgcctttaataaactggatgccttgtgacattttatctttcaataatatacaacttatttatatttatttaggttcttttttcattttatttaacttttgttgcatggatttctaaagttcttcatcatctcaatagcaatgatgttattaaaatagctacgccacatttaaggataatttgtaatgttaccttataagaacaaatgatcaaattatctcattggagaggaggaaaaaaataacactttattggcccattgtcaagttcattgattgtatatcaacaaaagaaaactattatctgagggccaatatccaattaaatatgctagcatgcatgtgaaaatgcattatccaggagagaataattaattcaaagctcgaaggagtcatgacaccagaaatctatttttgaaatagtcatacaatttgggtgcgagggaaggatatgataagcaaaaaaagaaaataaaagaaaaccatattgctttaactgtacagaatcatataaataaaaatgactaaggaacaaaaataaggactcttgttctggagatgagtagtagtgatggttgttcaacaaggtgaatgcacttcacatcacgaaactcaaaaataattaaaatgacatattctgttatgtatattttactgtaatttaaaaaaaagaagttaaataaataaataaataatggttctggatatttccagataacaaaccaccaaaaagcaaatacaaaaatggcttagacatcgttgctctgttgaaagatacttatttctccttgcacaaaatattacagtgtagaacattaatgtctccctgaaacatgtggctagaaaagaagcattagcctgttgtgtaggccaaatttaatttgagtaattatgttcttgctacctcgaagtcccttgaagtctctcataatctgtgtcccttctatgcttaatctatttacagcagtctgtggcctttcgagtaatcattaccatctgcccctaaggtagctgcatttcagcagaagggatcatgatttctgtattttagaagtacccaacatgaacaattattcccctgaaggtagatgatacaaatatatacgagatcacctgtgaaataaatgaaaaatcttcataaaaatgggtcatttttagtagtgataatattaatttcccattcctcctatctcctgaagtttgtttaaactgacacttttccatgatgaaggtatatttcgaaaataaataaataaataaaagcattatataccacacttttctgtaacatgggtgtgatatgatttttttaaataatacatttatatttttaaaataaacttttatcaggtgctaaaatatattttttgtttagttttgtaaactgggttgcctaagtaccactgattaattttaataacacttcttctttccctcattgtgtttctagaaagagccaactctatccacaaaaagaaggggagcatcttgtatgacatagaagcctccagataccttcctactgctctggcacaaggcagagaaattcccactattagcataactatttggattaaccacaagattatgtgtaaaatgcaaaagaattattgctttgggaagttaacccactaatttgttcatatattagcacagacaactttatctgttaaataactcaatgcaggattctgatgggatggggcatatagacaagtaggtttatttagaaaggcagcctagagtactggaaggggatgctgggtggacatgtattgtaggtcagccagaagtcactagagaatggaatggagtaccatagagagggccagcaggataaaaagcaattgtcaagtataaatcactaggatgtacctaagataacattcgcctgtgatgtaacttagtctatcttgcttcttaggtgtatttatagaaggtagggcactacagaacaagtcagaaacatcccagtctagacaccctggagccactcattctctccctgaatatactataccaggttcttcaccaagtaatttctgtaagttgtcccatgtatctttcctttgactgtgggcccagtttcactggccttctgggcaccccactgccacttctgtactctacttcaacctcactgcattttccacctcacgtgccactgaatctcaccacacaatctactctagccacgtggtccactggagctacacgctggcttccccagggacatccactctcccaaaattgctcaagcacttcaaacaacctaaaatgcgtatctgtcttttcttctgctatgaaactctgaatcttctttcaagtgcttgtccagatgccacttccttggcatgctcttttcctgccattcggaagtaactttaacactttgcttgcatctctctttagggcatctattttattttgcatggaagtgcatctactgaccacatagtacatatgaggtcacaaattgtaagaggtaaggatgtatcctcccatcccctggcatagtgccttacccaaagcagatgcttaacaaccatttattaaatttatttccagcagtgtggggtccaaaggcccaaagggggagttatttgagagtgcaaaggggcaaatagaagggacatgaagacaattccataggcttatctctcggcttctttgtacctttctgatagttttcttaattttcagtctcattacattagtaggggtcataacagtgctggaagccagtctccagcaggactagctcattctggagtcacagccaagcaagaagaggcaaagttaggacatttcttccctgcaagcctaggaagggtattgtttcaaaaagcaaaaagtgaaattacactaaactaaagtagcatgacaaagattaaaataggggacaacaatattgggattaatactgatcacgattaaatgaataatgtagcaatacctggattttcattagccagttctggcagtaataattttgtgttcagcagactcagaagctgtggtgtgaatgagactaacaactaagcactctctagttggatgatgtgaagaatcatttaccacatcttgctgaagaacattacaggttataaaaatgtcatctagaccatgcagacaagcccatctgtatttaaggctgaattcctttgaaataaaagcactccatgtggttcaaatgggtctgtgatttcaaatgtcagaaaactcttaacacataaccagaacacacagaccataatagggcaatcgaaggaatgtgagatatgaaatctttccaatagtctcacttagagcctaactcatcaaaagagtccattttatacataaagataaaagagaatgttttaagaattttataacatatcaatataattaatcagaacctatgatagcctttagtgcaattaatggctggagttctagttcatgaggtgttaagaaggagaggtcaagatatttatgattgtcattggataccatatgccacgtgtgggagagagggaggtggagtgttttatgagaataaactagaataactaaggataaaatattatttcaaactgagggaaaacaaagctagtttattttctagaattatatcaatgagctagattgatgtttgagatgaaatcaactactttaatacctatgcatattgatttatgtataaaactatgcatttatatattgatttatgtataaaagtatgcatttatattatcaatctctctctctgtcagtatggacaaagaatatatattagggtgggtgcatatatattttctgcagtttttgagcctagaggaaatcaggagtaaagctgtctggttggatttcttgacaacgtatgtctactcccctccttccatccctgtcattttctgaaactagagtagttgttctggaccttccccccctcctacccaatcttccttcttcctttctgctctctccctgtctcctgatttcactttctttatttcaggtgtatacaggtgggaaagctcatgagaagagcgtccctatctgaattatattttgctacccttcttgccatatcaaacccaaaataactgaaagaacatactgctcggtaatatgtcattaaaaagtgaattacctctaaccaagagggtgtttaattatctagtgtgaatcaatatattctactattattagcactttttaaagaaaattggtataaatgcaccataaaatgtcataatcacttgctttatacactactactttggtcactgacaaaagcctgcatagttaacatcagcttatatttcattttgaatcatattcttcaagagctctgttagcaatgggaatactttactttttaaaagtttctcttgcctatatttatgtgctctctttgtccccagtgcaatggtctgtgactattcaataaaatcttttaaactgaccatctactgttctgaacccaaaacaaagaaaaagtctgcaaatctgtgggataaatttaggttggcttaagctctagaataacacatacttttagtccaataaaaagaaactcactatgagtaagcgtcagtgacttcaagaagcttacctttatttggtaagaaagacacaaatactattaatcaaaataaagaaaaaaatagtatgtgacatggagtaagcatggtgcagagtggcccttgggggagaaagagcaagatcatttctgctgagcacatgagaaagcttctttgagaaactattcactgttttgttccagctaccatatggagaagctttcttacattattccatttaatcctcacatccctgacaagtagggagttttactatttcatgatgagaaaaataaagcttagaaaaattcattaatttagtgaaaaaaattacccatggccactaatccacaggcctctttctacaccactacatgatcttgcagcagagactggagggtgggtgggatttggaaaggtaaaatgggcagagtagacaacatcagctgaggcacaaaggtatgaggatccaaagcacatgtctcttgtggcaaaattgttcttttttatctgaaaaaaagaaaacttctccacactttaacctcctgtcttccagttacacctcattggcaagactgtcatgggagctcctctaactagaacttgggtgggcacactgctatcccaaagtaaattagactgtattcagccatacaaaatgagtagatattgggtaggcactagcatcgtctgtcataaagggtcagccacataggaagcactgaataaatggtagctcttcattattgttactatatctcattagtctaaagaacacatttcctacacacaaacatttcttaatgagtatatattttacagtggttgtgaggagcacattgcacaactcggctttgtgctgaaggtatttgatgctcatccctgtgtcactttcactggaagcaccacacatcattagactttacatttttatttctaattgtgatttaaaatgtcatcaaaaaagatgatactgtaggccaggggcggtggttcacgcctgtaatcccagcactttgggaggctgaggcgggcagatcacaaggtcaggagatcaagaccatcctggctaacacggtgaaaccccatctctactaaaaataccaaaaacattagccgggagtgctggcggacgcctgtagtcccagctacttgggaggctaaggcgggagaatagtgtgaacctgggaggcagatcttgcagtgagccgagatcatgccactgccctccagcctgggtgacagagcgagactccatctaaaaaaaataataataataacaataataataataatgctgtaatacaacattcaagcaaagggttgttacaccaaatacgatagagatagagttgaagaaagcagatttcctttaagaggcagtgttgctagtggtcaaaaacacacttgctggaatcagaagcttccgatctagttcttccactcaagagccaggtgattctggggaagttactttctctcctgtttcttatccataaaatgggggtgacaatagggtaagtgtaaggattacatgagttaatattaatgagtgccaacaattgtgtttggcacataggaagtgcttaataaatgttaactatcattgttagtaataatgttggaagcaggccaggtgcagtggctcaagcctataatcccagcatgttgggagggtgaggagggtggattgtttgagcataggaatttgagaccagcctgggcaacatggcaagacccgtctctaccaaaatacaaaaaaatggctgggcatggtgaagcatgcctgtggtcccagctacttgggaggctgaggtagaaagatggcttgagccccatggggcagaagtttcagtgagctgagattgtgccactgtactccagcatgggtgacagagtgagaacttgtctcaaaaaaaaaaaaaaaaaaaaaaaaaaaaaatatatatatatatatatatatatatatatatatatagtttgaagcaatgatcactgtaggtaaaaaaaaaaaatgtgtattatcatgttataaatccaacatcaagtggtttccaatttttaagaaagaatatatacacatataattaaaaccttgtgtatatttatatgtgtgtatatgtccatgtatatgtatagctattaaatttaaaaaatcacctaatatgcatgcgaaaggataattaaaagcaacagaatttgtcaaatatcctggaatatcataggattttaaaaactacgagaagttccagagatccactgtgtttaattaaagactaaaactcaattactgtcaaaaacttccagctgatgttcaagaaaaactgtttaatatccagcagtatctacttctattatggaaaatttaaaactaggaattcaacaaaataggaaatgccaacaaaacctggtattcttccctatgcttcaacattattctgtcaaagctaaggcaagtgaagaggtcaagatcagaagcacaggctttggaaagtcactcaacagtgggtcaccgaaggtcgtgcagaatgcacagactatatatatgataaaggcttagactgaacttttgatcatgatacagaagagtctagtcaaataaaatcatttgaataaatgtatgaaaaagtgggtttggttaaaaggaaatcatgtacatttaatgtagagtttcgtcttttgcagaaatatgcttctaaagtcgatggtgaatcttacattagatggtatcttggatctatgttgtgattccaaaatttgtccttcagtgctaactgtgaatcaatcagtccaaactttatttgtggaatgaagtttaatattaaaatatatcgtattttcaaatttaaacataaagtttgaatcataaatgcctcatgtcaacagcggcctcatactttactcataaatattccctctttcattataatttggttgggtttttgaaaggaatgtagacaaagtgtgagaactcacatcatcccttggcttttatgctttaagatctaattttcaaggcttaaatatgtctgatgccgtgaccatatggcagtgttttccatggatagaaatgatacatccccaaggacagaagtcatgctgcaaaagaggatggttttcctcctattgaaaattagtctattcaatcaaaatctcatgaaaacattggctagttttctgtgtatagctcgcacttcacttaccagactgttgcctaaatcttccctattctggaagactgtatatacagtgcaagtattatatgatataaccaatttccaaatgctttctaattcccacagtggggaaagaacaactggcaacacagtgaattatttcagtttaacagctgattatcaagacaaataactggatattgtctgcagtgacaaccatgaccagggtccagggaaccacactcagaaaaggtcataatagataaccattttcccaaaaggaagaattattctctgtgaggatactaatgtctccctgttctgagttctgttcagtctacagtccattctctacactctccccagtgttattgaaactgcctttgcaaaatcatgatagcaagagaagtccgacagtgttgacgccatcttacttctgacctctgaggtgtccttggtcattcccgggcataggccaagctaacttttgaaggaatttagtttatagtttaacttgaaagctaggacgatactagtctccccttaaaactaaccctttccttgctcagggaccaaaaaccacctttgttagactaataaaaggccacaagaataggattatgggaggaacctgaactcttctgagatgtaggcatagtttctctaatctcttactgctctggagtcatgtggccagaagtcacaagatctctgacttctccaattgctcctatagataacatcattattgtagaacctaagattggtttttgagtactttttcagatgaatcccaccaaaacttgtgactcatgactcaactggccccatggccccacccagaggaagactcagcacacaaaggctgttttccacacccctatgattttattcccaaccaatcaacagcatcaattccctagccccctgcccaccaaacagtccataaaaaccctagcctccaagctattagggaggttgagtgatagctccagttctcccacatgggctgaactcatgtcagttaaactctatactgcaatagcaccatctcaattgattaattttgtctatgcagtgaacaggaagaacccattgagtgaccacattacaagtttaaaatgtttttctggtgagggaaagagaaataaaacatggcttgtctgattagtactaagtagtacttcaacttcatgatcattagtattcaaaagacttcaacactgcctgggaatctcactagatttcttagccatctggctctctctcactcggctcaacaaatagtgcccctcttctacctcctactaaatctcagtttccatttgccttttgcctcagctgatgaacttaccctatattttaccagggaaaatagaagtcatacaccatagcccctacttttattccacaactgaattttcaaggtcttttactcaccccctccctctctgtctctagagctgaagtagagagaaagtgttacattaagggtcaatcccactgcactctggtcatcatccctccacatgcccaggggcctctattcacaagttattatgtcttactgctttcttaacctcttcttccctgccaacacttaacctatctgcattcaaatgcagattggtttactttaggattaaaggaagaagtgacttcagggtggaagagagagaagaagaaaaggaagagagaaggagggaaagaaggaaggaaggaaggaaggaaggaaggaaggaaggaaggaaagaaggaaggaaggaagaaaggaaggaaggaagttcctttgataccctgatccttcttcagctaccaccgtatctttctacttttcttttcagccaaaggtctcaaaaaagttacctaaaagactatctccactcactaacccatcttccttcatccttcatccctctgtaatttcctccctctctcagcattgaaacttccatttcaaaggctacaaattgtgtccatgttgccaaaccaggagaggcttatcagttcttcctcacaatggcctctcagctgtgtgataccacccacatgcttaagagaaggcattctgcaggcttaggtaagtctgaatccaaggctcaccacacactggatttatctataaacttttaaacctcctcatcaataaaatgaggatagcaattattttcctccattggctttttgtagtgattaaatgatataatccatgtaaagtgcttaatcttgtacttggcacatagcaaagattctacagttgtcagtttttatagctggtaatactcttggtgttattcttctgtaattgttctctcatgttgcatttcattaaacaacactctccagaggaagagagatggttgtcccatttcctgcatacagtggccagggctggtgctatatttactttgagccatcatgattttgcccaggggtggcagcaatgttgtctttctcagatgacttttagggggtgattctagggccttgttcccagtgggtaatgctggaaggtctgcaaacttcacagtatcttttaataaatctcctttaggagccaagcacagtggtgcatgcgtgcagtcccagctactcaggaagtgaggtgggaagattgcttgagccccacagcttaaggccagcctatgcaacacagcaagacccccctaaatcaacaaatgtataagcacatttattgtgaaggatttagggggatcttgctctctacataaatagatggatagatagatagatagatagatagatagatagatagatagatagatagatatagatatagatagatataaatagatatataaatatatctatttatatatctatatatcttacgagttaaatttgccatatttggcttttattgcttgcaatgaaaaattctagtcaaatatctaactcagcctattcccttcttcaaatttcagattcatatattcaactacgcccctgacattccaactcagatatttcatagccatcacaaattaaaaaatgcagaaatgaactatcaagctccctctcctccattccaaaccacttgcctcttagcatatggaaacaccatccagagttgcttacatgaagaatctggagccatcattgaaagctctctctttatacattttccaagtggtcagttttgcctcaaaatacacttcaaatttgtccactcatttctctctgcatttgttaccaccttaagttgaatcaccattatctcacaaatgcaccgaaacatctgcttgtaaaatgtctcacccttttcccatgttgttctcttccaatgcattttcttcatagcaaactaaatttctagaaacaaaatcatgtaattaccttaatcaaaattcttcaatggtgtgccattgtacattggaagaaatccaaagtttttactatcacttccaaaacaatgaacaatttagattctggctagctccttagctgcatcatatgtgccatctcacattcaattctccaggatcctacctcatttcacctccttaaaaccgataggcttttctgttttgggacctttgcacaagctgtttactctgccaggaaggtgctgcccacctgatctgacctcattgcaaacttcagagagacctttttatcctgtcagtgtcaccaaagagtccttattacactctctcaagccatcccctatatacctatcatagttcacagaaatcactgatttttaatgtgattattatctatcctccctatctgtctgattttcattaaaattgtcattttagtaaaaattttctgattttcataagaaatgacaattgttctattttatctatctctagtattttatgcctaatgtagtgccaggtacacagagttgctgttcaaaaatatctgttcaatgtttgaattaattattttcaatcacaacacccatgattcctctgtggtctgtagtagttttctttgtgcagtgtctgtcacagctctaaagagaagggtaagaacaatagaactgtctaacaggacagattcattagctgagattcaaaaccaaaaggcaaatctggctaatttctcagatgactggatgcatttatgcttttggatcagggatgacatttgctgatagataccaacaagttgcatatctagaaactccattatctgaaacatacacacaaactcaaacagaaaaatttactatgatttaaatatctttaaatgaacaaatgctgaacgacactgatattaagacctatttattagagcaatataatccttagatgaagaatatagggaaacaccatattcccaccatatttactggagtagttatctttacttctgtggcatccctacagtgatgatataatttggagacttcatttgccagtcatttacgaaatggctgtgagaagaaagtctcatgatcatagactcacttttagaagctatgttagcttggtgcatttcttagtcaagtacatcacactatcttaatctatgtctaaaaaatgtggatcccaaatgtgaattatctattataaatgtgataacagagacaaaggagggagatccacttaagagggtatgatggttaataccgagtgtcaacttgattggattgaaggatgcaaggtattgactctgggtgggtctgtgagggtgttgccaaaggagattaacattgaatcagtgggctgtgaaaggcagacccacccttaatatgggtggccaccatctaatcagctgccagcacagccagaatataaagcaggcagaaaaacatgaaaagactagactggcttagcctcccagcctacatctttctcccatgctggatgcttcctgtcctcaaatatcggactccaagttcttcagctttgggactcagactggcttccttgcttctcagcttgcagagagcctgttgagggacattgtgattgtgtgagttaatactctttaataaactgtcttttatatatatatctatcctattagttctgtccctccagagaaccttgactaatacagattttggtacctggagtggagtcagtagagacattccttctaaggtgaaggataagttgctgcatttggcccctcctacaaccaagaaagaggcacagcgcctaatgggcctatttgatttggaggcaatacattcctcagttggatgtgttactttggcccatttatcgagtgacccaaaaggctgccagttttgagtggtgtccagaacaggagaaggctctgcaacaggtacaggctgctgtgcaagctgctctgccacttgggccatatgacccaggagatccaatggtgcctgaggtatcaggagaagatacggattgtatttggagcctttggcaggctcccacaggtgaatcacagcagaggcctctaggattttggaacaaggctctgccatctcctgcagataactactctccttttgagagatagctcttgtcccgttactgggctttggtggaaactgaatatttgactatgggtcatcaagtcaccacgtctgcctatcacttgaactgcctatcatgaactgggtgctttctgacccacctactcacaaagtgggtcatgtccacagcattccatcatcaaatggaagtagtatatatgtgattgggtttgagcaggtcctgaagttatatgaggaaatggctcaaatgcccatggtccccagtcctgccaccctgccttctctcacccagcctgcaccaatggcctcatggggagttccctataatcagttgacagaggaagagaagaccagggcctcgttcacagatggttctgcacaatatgcaggcaccacccaaaagaggacagctgtagcattatagcccctttctaggatatccctgaaggacagcagtgaagggaaatcttcccctgtgggcagaacttcaagcagtgcatctggatgtgcactttgcatggaaggagaaatggccagatgtgtgattatatactgattgatgggctgtagccagtggtttggctggatggtcagggacttggaagaagcatgattggaaaattggcaacaaagaaatttggggaagagttatgtgaatagacctctctgagtggtcaaaaactctgaagatatttgtatcccaagtgagcgctcaccaacaggtgacttcagcagaggaggattttaataatcaagtggacaggataacccattcaatggataccactcagcctctttccccagccacccccgtcatcacccaatgggcccataaacaaagtggccattgtggcagggatggaggttacgcatgggctcagcaacatggacttccactcaccaaggctgacctagctacagccactgctgagtgcccgatttgccagaagcagagactgatgctgagccctcaatatggcaccattccttgaggtgatcagccatctacctggtggcaggttgattatattggacctgttccatcacggaaagggcagaggtttgtcctcactggaatagacatgtactccagatatgagtttgcctgtcctgcacacaatgcttctgccaagactaccatccatggactcacagaatgcccggtccactgtcatggtatcccacacagcattgcctctgaccaaggcactcactttgtggccaaagaagtgtggcagtgggctcatgctcatggaattcactggtcttaccatgttccccatcatcctgaagcagctggattgacagaatggcagaatggccttttgaagtcacaattaaaatgccaactaggtgacaatactttgcagggctggggcaaagtcctctggaaggctgtgtatgctctgaatcggcgtcctatatatggtactgtttctcccatagccaagattcactggtccaggaatcaaggggtggaagtcgaagtggcagcactcaccatcacccttagtgatccaccagcaaaatttttgcttcctggtaccgcgacattatgttctgctcgcctagaggtcttagttccagagggaggaatgctgccaccaggaaacacaacaataattccattaaactggatgttaagattgccacctggacactttgggctcctcctacctttaagtcaacaggctaagaagggagttacagtgttagctggggtgactgacccagactatcaagatgaaatcagtctactgctccacaatgaaggtaaagaagagtatgcatggaatacagtagatcaattgcggcgtctcttagtattaccatgccctgtgattcaggtcaatgggaaactacaacagcccaatccaggcaggactacaaatggccaagacccttcaggaatgaaggtttgggtgactccaccaggaaaaaaccatgacctgctggggtgcttgctgaaggcaaagggaatacagaatgggtagaaggtagtcatcaataccagctacgaccatgtgaccagttgcagaaacgaggactgtaattgtcatgagtatttcctccttcttttggtaaaaccatgtttgtgtatgtatacacctgtactaaggaaatatgttcattttatttcctttttcttttaacatgtgacatcagatttacttcatattagcgtttaagtatcgttagctttatgtaatagcatttgggttggggattggtgcatttctggttgtacgaaggatagctgcattatgttacgtgtaattatgaccttattattgtctttatttgaagataatgtgtgatctcagatgcgtatgggttcaagtcgacaaggcgtagacttacaatgattaatactgagtgtcaacttgattggattgaaggatgcaacatattgatactgggtgtgtctgtgagggtgttgccaaaggagactaacatttgagtaagtggactgggaaaggcagacctaccttcatctgggtgacaaagagggtgacaaagaaatcatctggtgggcaccatctaatcagctgccagcatggccagaatataaagcaggcagaaaaatgtgaaaagactagactggcttagcctccaatcctacatctttctcccatgctggatgcttcctgccctcgaacatgagactccaagttcttcagctttggggctcaaactggcttccttgcttctcaacttgcagacagcctattgtgggacctttgattgtgtgagttaattccttaataaactcccctttatatatgtatatatatcctattagttacatcactctaaagaaccctgaccaatacagaaggcttacactctttattctaacaggcttaaggctaactctatatgtctccttcccaatgtcaggaatctctgtagcttagaggaacagttttcctcagtgacatatgtaactcagtgattagtcacaggaacactgacctcatcacaataaaatagggatctccctattttaagatccccctaaggaataaagagctatgcactttagggaaaactctataaaacgtgtgagaatcaaaagagttcaaaaatggccaaaaccagccaggcaagatagtgagaatacatgtctacagaaacattttttaaatagcaaggtgtgttggtacatgcctgtagtcccaactattagggaggctgaggtggaggatcacttgatcccaggagtttgaggctgcagtgagctacgattgccactgcactccatcctgggtgacagagtgagatcctgtctccaaaaaaaaaaaaaaaaggcaaggagagggtgatccttactaaaacaggcaattcaatattcaattagggggattcattcaaaccatttatttcacagaaatggccaaataagtggccttgttaataagaagataaaaccctttcctttttgcattaaaataactgattttgtctcaaattatattaaataaggtaactacaacagaaataagaagaaaattacattgattgtatagacaagaattagtttctgaaagcacataaacctttacagaaaatacgcttactttatcaaagtggttcagttttcagctgcttctatggcttacaacaaaaaagggattctgttacatatggaaacttcaaaaatcacaaagctcaaataaaaataatagtccagggcaattaatctggaacaagaatacccatgaatactctgggtatttgttttaatgcacttcagttcaatagtgttgttttctttctcatcaaagagcaaactatatttctatttatcatcttcagaagtagtaacagagcctatcctggtaatatgcattgtggggaagaagaggatacaattgaacacaaggctatttcaaataatagaaaagatacctttaataattggcaggagatcttataacacaaactataaacaactgctggatttgaaagtcacaaaagcatagtcctagagtccatatcgtgggatcataagacagttacagctttccctagagtcaagaggaaatgtcatccattagaattcaagtgaactctctatatacccatttatagaaataactagacccctaagcagattcaggtacattcttcttattcttctacatctggccctgaattaggtgaggtgacaagtgtgatttttcagaccaactcatggtctttctggcttatggttatactgatcgcccctggtgacttgtgtgtgaacaaacctcagagcattcaaatccctgggttctgctctggctctgctagtatcctgctctgcaaacttaacctctctgggctttcatttctttatcttcaaattgaagaaaaatgtgatactttatccttaaggtcaacctctagttccaaattcttaatcagaaaaattatggcaggcttatggtctacagaattaaaatcaaagagccttgctgaggtaagcgacaacatttgcaaaggacaatgtaaggttcattttcttctagcccgaatgaattgtacccagtatttatgtggacttgaaaactataagtgtttttaataaattaaatctaaaatgaaggcatttaaaattattagcggcttatcagcatgaaacacaaagaacactgaagtgggagatttttccagtgaaactcatcattaaactttcaataacaatgtcatcatttcttttcccttctgtgatcacaccatctcccaggcacaattttaggtttaacagtcttaaaaccaggtaagactagggaagctgagcaggcaaatcaaatgattaagttttaaaaagttttataggtatttaagccttgggaaagcttaattaatgaagaatttaaaacaggagtgaaaattaaagcagtaggaaatattcaagaaaaaaattactatgccattgaaaaaattcaggaagagccacagggaactaatgcaaataatcattgactggaggaaatgtctctggcaaatgcaagaagtgacccaaagaaacagaactgagaaaatttggccagaaaagtaaaaaaagaacatacataaaatggatggtacaacattgcttttatttttcaggaagaaaatgtgattgattctgcgtaaaggtgcttttcataacttttatattgtcataaagacaataataatatccttagctcttcatattcctttgccagtctatcattcactcatgttttcaatgtaatattcagaacccactgtatcagatcatctggttgagttccataccaccatcttctctatccacttatcctatgagatcccagttgcatcccataatctttttaaatataatggaaaatttaaaacatttcatctgatatagtttgactctgtatccccacctaaatctcatctcgaattatcatccccatgtgttgagggagagatctgatgggaggtgattgcattatggtctttctctctctctctctctctctgttgctgtctctctctctcagtctcagtatctttatagcagtgttaaaacggactaataaatcatccttcttggtctcaactactggtcattcatcttaaaccatgcttatctctgatggatactatctagaaataaacacatgagatgacattttcttggatatctcattacaaacatattaggcatctgaatcagtattattgttttaatttatcaaataatgtccaaaattatgatggaaacaaaatagctggtccaaatctaaagaagatattttacttgcttaatcacaaggattatttaaaacatccacatgtggtttaactgactcccaaggtagatacatttccaaagcatgacacaagggaaagatatagcattaaaatcacattccagggtacctatatttatagaaacacacagaaaatgggctaatctttgcactttctcctattgagagaaatagatattctactcaaccctttcttcatagctggtaatgtaacataaataataaaatttatcttaaattgcctaccaatcatcaaattcagggaactgtccactgaacttttagtattggctttccatttgttggggaggggaagagtggggttacaaattatagactagaaataataacaataaaataattccaaggggcattaaatgccagagttctggggatttggagattggggtaagataactagagtaacttgctgactgtgccccacacatcctttccttctggtagtcaaaacagtgagaaatgtgaaggaggggcttaggcaaaagccagccttgacggcctggggcatcttattggcatttgaattggtgagagagctaacagtttccactcctcctcatgttattttggaagcaagacctaccaaacaggccaggcacagtggctcactcctgtaaacctagcactttgggaggccaaggcgggcggatcgcaaggtcaggagatcgagaccaacctgaccaacatggtttctactaaaaatacaaaaattagccaggtttggtggcacgtgcctgtaatcccaagctgctcaggaggctgaggcaggagaatcgcttgaacctgggaggcggaagctgcagtgagccgagattgtgccactgcactctagcctagatgacaaagcaagactctgtctcaaaaataaaaaaataaaaaaacaaaagacctaccaaacagaaccacagccactaaaagaagatcagagttaacagttggacagagaggggttatttctgcatgttggagatgcttgtgttcacagagtagctgtgtttatcattaataataataataataaaaagttatgcctctcatcagtaagcatagcctttaaaagctaggcatattcagggaaacaaattcatccacttctgacatcggttgcagggtcttacctctggcaacagattaatgcattagcaaggaacccaaatgaaaagtgcttatgtagacagcacaatggctgtgatttagtaatgttcgtacagcaatttatatttactgagtgctacaatggtttctattatttattcttcaagagaaatccatgaggtactgtcttcatttttttaggtgaggaaaataaggcatagggaaattaatatggaatcacagagatcaagtcaggttgtgcctgtacacacaaaaataaccttttagaaaggaaaaatgagcttaagttacgagatcaagtcaggttgtgcctgtacacacaaaaataaccttttagaaaggaaaaatgagcttaagttacttgcttgacattaaatattacattggtgcaaaagtaattgtggtttttaattgtggtgaaaaccgcaaatactcttgtaccaacctaatagagcagtggacactgacatattttcttagcagtaaaaacaacccccccccaaaaaagtcacatacaattccaatttacaaacaagataacaattacacagcattagtaaaccaaatataaatttctaacgtttactaattattagggcaatcaatgctttaggaacataaactttgaaatcagagggcatgtataatagttccaagcttctatcactctcagcttctgtgaatttcagaacttctgaactccagagtctgcaggctttaggaagaaagtgtttgcctaaacataacaggtcaaaagtataaattcagtaaaactactttgtttgcataaacctaatgacatagtgtgtatgctgggaatgtacttgaacctttgaattcagttgtttaattagtgagctattgtggtgggggtggagtgagtggggaaacccacagaggaggagcctccgctgagtgatttaaagcgtgcaggaaagaaggcctgtggcctgtgtatgcatagggggagctcctccctaatcctcattatagatttgtgttctctaaagccggaaacgacaaactaaaattaagtaaagagatgctaacggttatattaatttttaaagaagaaacaacagcctgcagctgatgatgtgttggctggaatggcctgagccgctgggaaagaatttaatggaactagagcttttaaaagtcatatgagttcaaaaggggaaacaggaaaaataaataaagagaagtaggcagaaagaacaggtgagattcagctgagtgaagttgatggcataacatatgctgaggccacacatttccaacaacagtccatcagccatgagctgagttatggctcccagagtcatggaaagcagttctgaacagaagctaaatgttggtgaactcaaattccaaaaagaataaagtcatgcttctccagagaccaaagagaagataaagaaaatggcctggccttatacttgagggagaaagcaaaatgatttacaaagaacagaactagtgattggaaccaatgagtaggactggatgagcagagaataggatctaaaactggcagtcttggaaggagcctaagagagcatcgaatccaagaagtttggggatgataaatgtgaggcacatgtatcacctgttatctatgtccacagtccactcaatactgcaacctggtccaagatgaatcctgtggcattgggtttatctgttaacagtttataagaagaccacattctagatcaactggagcaaaatacttcaactttttacaccagggaaccagggatgatgtatgtgctctaaggaactggaatggaggaatatactttatgtaaagaaggaagaccagaaatcccaatattagattggaaaaaaaatcctcttcgtcttctgccgggcccgcccagcagaccctggccaaatgacagatgaaaaaacgtacacagacacaggtgttttgcctggccgcgcggctaggggaccgagccactcacagacatcaaggaggatgccgtaaagagtcacagaggccgcagccttgacaagcggccgctacagtcatttattcagtacagatataaagacaaaggccttgaggcaacacacttgtaggtaattaatatggttgcgccccgccccccgccccgcccccaggttcagaggcctaagtaaactaacttaccttgatcaattctcttacacttccttgttatctactcttagagaattcagctgccttcagcccaatcctttcccaaagcttctgcaaaacctcccagccttccaggaatgtttccatctttctataatttttcccaccaccctgaccgatctcctacaatctccaaaattgtgaaatagaaaatcaagctattacaagtggcagggggaacctacctgtggtggcatttctgttaaataataatgtgtacgtgattgagctttgtaaactaaaaataactagaaaagggaagtgatgctctggagtggctttagatttgagtgtttacttcactatacatacatatttttttcctaaatacaaatatgatacgtccatttagaatatttggaaaacagaagtgaaagattttttaaagagagagagaaatattcaaccataataagccttccacttagaactgatcactgttaacaatttggtgcactacatactagtatttaattcatatgcagatctgtgccttgtttataaataaaagtgagacccttttcctttctttttacttggcaatacattgtgtgctttgccatttcattttattcttaaaacattaaagactgcattaaattctactgcttttcatcaattctctaaagttaaaaacttaggtctttgtatttccactatttcaaataaaagtgtggattgatatccttgattttgtttgcatttatttgtgtgctagtaagactaatcatttttcatgttttgggccatttacacttcttttgtatattggtttcatgttactgtccatttttttcctagagtattaagctttttaaaagacctctttacattaaatatattaatccatcctctgtcatatacatttaaaatatcattgatttgtcttatttcatttaaggtattttcttcaagaggggaggcctttagtttttatgtagctaaattttttccttcatggcttttgtttttggtgacaagttttgaaagatctctgtgctgcaactacatatacatattcagcagtagttccatttagttcttttaacgagcattgtttaaaagcgtggggactggaagccattcctaacactgaccttaatcttatgatctattctgcctccactgatctatgattaatctgatctgtgctttaatttctttatcataaaactaataagtagtactagtatttgcctcacagagcagttaaaagtagtaaactggataatctatataaagtgcaaggcataatatctggcacataataaataataaatgctagggattatttaactccctaatatctacgaacattattttagagactatgatacaaataaatctaagtttaattttctccaaatttgtgccaacactatattttgaataaaacatattgtgtctcactaattttatatgccacttctattatatactaaatgattacaggtgtttggatacatgtctacactttttattgaagtctactgatttccctggctagtaatataagtctactacaatattaaaatcagtatggctgaataatattttaattacttttagtgcaattatccgtccttaattattcttttctcagaaaatacccctgactaatcaggctgccaaaacttctggttaaagttccaagagggaattaacaaaagtatatgaaactgtcattcttataacgagcactacctttaaatattttttgggaaagtccaaggtgaacttttctgcccaaattatatttcacaccaatcacttcctagtttctgtccagtaaagtataaatgtataagggtcagtatcaactgtcaaaacaaatcaggtttttcgactgaactcattgagatagagaatagaaggttaccagagactgggaagggtagtaagagagatggcatggagaggaggtggggatggttaatgggttaaaaaaatagttagaaagaatgaataagacatagtatttgatagcacaacagggtgactatagtcaacaatgacttaatttacattttactaacattttactaaaagagtgtaatcggattgtttgtaacacaaagtgtaaacataaacacttgaacggatggatacatcatttcccatgatgtgattattatgcactgcatgcctgtatcaaaacatctcatgtaccccataagtatatatacctacaatatacctacacaaattaaaacttaaaaaaatctctttattttcttgtaaatgatctttattgaatttgaatttttatatcttctaatataaaacatatgttttaaaaaactcaggtttctaagtgtacccttgtaaaacatttaaaggccaaaaggagaatacattgtaccttctaaatcactttctaaacccagccctgggaccctcaggactccactcattacaggatgggggtcagccagcatgaatagccccggcttcattggtgatcatgaggagcaagaaaacaaacacctgaagagcctgagaatggaagcccaagtgtcagttcttccttgtagtgcctctgcactgtcgcaaatgggctgtggggagactttatgtgcctcactcagggggttcgtcatgcctccttctttgagtaggaagaggaattggaaatatacaagcatcagaagtgtgactgccatactcttcctcccaagagagcagatttaaaatccactcatagagatggaagtaaaaaagctccctaacaacttgtttcaaatcaatatgccactttaatatgagaaagttcccatgtcttcacagtggcttcacaagtggatttctgtcttgtctcatatttaatgattctataactgtgtgtgcaaagcatatgatttgatacatgactaaaaaggtattgttattaactgttaaaataccatgactacattcctactttgctcagttttaattttataataaataccttaagattttccaaattgctctaaatttacattttgtaacaggttcttcaagtttgttttgttttgttttttattttctccagggattgggaagcttaaaggaaaataagactgcaaagggatctcttaatagaaatgtataaattatgctgaagataacagaataagcaatgataaaaactgcaatttttcaaattaagtctggccaccaagtagattgggagtgtgaaaatgaaagaaaccataggaaaaaagtgtctatgacatcttaagcctcatcagagctagtgaaaggaacattagctttaatcagatgaatagaagccaggaagggaggcttcaaaaaaaagtcctaataaaggggagcatgaaaccatggctgaaactctgaaatggaagaaggctcaagaggtttattagactattcagaaagaaatttcaatttttcttctgcaaataattcagaaaacaaaaaaggtgggggcaggaaggcatatctaaagagatcaataggaatctctgatgacctcaaatttcatgaggatttgtgcaaatcatagaaggacaaatagtacagaggagaatgttcctaaacttagagtcaggaaagctcaaaaacataataagctaaggcttgaaaatgtatagacagcaagaaaaatattctattttttttttctttttaaagtgccatccagtacaacaagagtcgtaaagccaaggagcttccgttcatcacagaggaaatggattatgaaatgtttagtgttgatggatggggtgttgctctacttctcattattttctgtaatagaggacaactgtcaattaaagaatgttggtgtcaatactggcatgaagccaggcacgaagctggacagacagggatattgtaaaatgcattttctcactctgaaggaattagagactctcagccatgttcacttatgggcgaccacatgtcctcatttgtctgagatattcctagcttatgcctgcctttctggcatagctattaatagacctcctttccattttaaaagattttaagcactgagcagaccaatatcaagttccaaagttgaatcagtaataccaacaaacaaaagccctacggcagatggattcatggccaaattccaccagatagacaaagaagaactggtaccaatcctactgacgctattccaaaaaatggaggaggagggactcccctctaactcattttatgaagctagcataacccggataccaaaagctggcaaagacacaaagaaaaaagaaaactacaggccaatatccctgatgaacatagattgaaaaatcctcaacaaaatactagcaaactgaatccagcagcacatcaaaaagttaattcaccatgattaagtaggcttcatttccaagatgcaagcctggttcaacatatgcaaatcaataaatgcgattcaccacagaaacagaactttttaaaaccacatgtaatcatttcaatagatgcagaaaaagcttttgataaaatctaacaacccttcatgataaaagctttcaacaaactaggcatcaaaagaacatatctcaaaataataagagccatctatgacaaactcacagccaacatcatactgaacaggcaaaagctggatacatccccacttagaacaggaacaagacaaggatgcctgctcccaccactcctattcaacatagtactggaattcctagtcagagcaaccaggcaagaaaaagaaatcaaaggcatccaaataggaaaatacatcatcaaattatctctcttcactgacaatattattctatacctagaaaaccatctcagactccaccaaaaggctcctattctgataaatgactttagtaaagtgtccggatacaaaatcaacgtggagaaatcagtagcatttctatacaccaataatgctcaagctgagagccaaatcaagaacatgatcccatttacaatagccacacatacacacaaatctaggaatatatttaacctaggaggtgaaatatctctaaagggactacaagacactgctgaaagaaatcagagatgacacaaacaaaacaaaaaacattccatgctcatggattagaagaatcaatattgttaaaatggtcatactgcccaaagcaatctacagattcaatgctattcctatcaaattatcaatgttatctctcatagagttcgaaaaactattctaaaattcatatggaaccaaaaaagagcccaaatactcaaagcaatactaagcaaaaagaacaaagccaggggcattgcattattcaatttcaaactatactttaaggctaaagaaacaaaaacaacatggtactggtataaaaacagacacatagactaatgtaacagaataggaaacccagaaataaagtcatccaatcttcaacaaagttgacaaaaataagcaatggaaaaaaggctccctgttcaatatatggtcctgggataactggctagccatatgtggaagaatgaaactggacccctacctttcactatatacaacaaataattgaagatagattaaaaagttaaatataagacctcaaactataagaatcctagaagaaaacttaggaaatacaattctggtcattggccttgggaaaaaaaatatgagtaagtcctcaaaggcaactgcaataaaaataacaatcaataactaggacctaattcaactaaagaccctctgcacagcaaaagaaactatcaaactgcaaactacagaatgggagaaaatatttgcaaactatgcatccaacaaagttctaatatccagaatctataaggaacttaaacaattcagcaagacaattgtaaaaaccaataactccactaaacagtgggcaaaagatataaatagacacttcttaaaacacaaaagcagccaaaaaacatggaaaaatgctcaacatcattaatcatcagataaatgcaaatcaaaactacatgagataccatctcacaccagtcagaatggctattatttaaaagttaaaaataacagatgttggtaaggctgtggagaaaatacactgttggtgggaatgtaaattagttcagtcactgtggaaagcagtctggagatttctcaaagaagttacaacagagctaccaatcaacccagaaattccattactgggcagataccaaaggaacataaatcattctaccaaaaagacacatgtgcttgtatgtgcattgcaacactatttgcaatagcaaagacatggaatcaacctgggtgcctatcgacaatggactgggtaaagaaaacctaatacgtattcaccatagaatactatgcagccataaaaaagaatgaagtcatgtcctttgcagcactgtggatgcagctagaggccattatcctaagaaaattaatgcaggaacagaaaaccacatactgcatgttctcactcataagtgagaactaagcattgggtacacatggacattaagatgagaacaacagacactggggactactagaagaaggaaagaaggagggcggaagacgcaaaaatctattaggtaccatactcactaactaagtgataggatcatttacatcacaaaaccttagcatcatgcgatatacctaaacatgcacttgtactccctgaatcaaaaataaaagttgaaattatataaaatataatattaaattatataaaataaaactatctttatttgaatgacaaattatgtagtcatctttaacatatatcaacatgccaagagtactgcatgttttattgttttcaataatcttcttgataatctgaggaacagattatcaaacagatttttgtgatgactttgaaagagagaaagcaaacagaaagaggaaacatgggtttttaaagactaaattaggtgagagcctccttatttctttcttcattagggctattgcagtacatgtcatgggatttctgtagatagatcaaatatggattttaacaagacctcagacaaagatctttttgatagttagagtcaaggacggaaatatgaattgtcatacagtctgatgtattttaatgagttgaatggctattccaaatagtgttgactaatgtttactaatgagcaatgtcaactctgcccttggtactgtccttttcaatatttttatcaccaaattgtattaagacatgctgatcaaagttgtatctgatgcacggtaatagcagatattgagatgacagagtcaggatccaaaattatctcatcagactaggaaaatgtgccaagcctgaaaaattaaatttcatggggaaaaacaatttcacagggagaaacttatttttccaaagaccagttgcacaaaaataataagagaaaatatgagatgaaagaaagaacgtttttgctgattaaaaatcataattggtgaactggccacaaaagcattaatatcaacattaagaggctgatgtatcaatcctactgcgtccagcatgtcacacccaaaataacatgttccactctgggaacctcagcttaagcaagatagtggcaaactgagaaccatacaaaaaaataataggagagtaaattctaacagtgatttaaaaaaaaaagaataagaacaaaaatagtaacaacacagatttgcaatcccttatctgcagttttaaaatccaaagtgtttgaaaaccaaaaatatgtttaatttttgtcaaatcctgacctgaaatagagaaggtatctatgctctttatctatttcaacttgttgtacatataatttgctgtacatatttgcataaatattaatatacttgattatgggattctgccttatgctccattggggatattacataatatcaccagtgtatctctgtattgcctttaagaaaaacccaacaataggaatttcaaaatatagctggtctcaaggtttggagtaaaggattttgacctaatggtaataacaacaataatgataataataacagataacacaaaaatagcacttactatatgtcagacactgtcctaggaacttagcatatattaattcattcaatttttgcaataaccagagatgtatataccattattattatcctcactctacaataaagtaaactgaagcacaaagatttgcccagagccacatactaagatgctatttgaatgttaatatgatacttgaatagttgtcttcaagttgaaacattgtacgtggaagtagcaggaagcaggatgcctacaaatgtaaagcttaattggggtgtcactgtagaatgttcttaaaatattttgaagcttacagaaatacaccttgaagcaaattatttttgcttgagtagtctttctttgtaattttagaaggaaaatgtgccaattattcagggaggatcaaaacagaaaataattttgtaattgatcaaaccacaacttcctaaagctactacaatgcaaagttgaagcttcagaaggaaaagagaatgagaatctgacaatggacttccaagattcaaagctgaggagaaggtggaagggaagcacaacttcaccttaatgaaaaggaaaaagaatgatgtaggctggtgagccaggcccaagacaggtatttaaaggcaaagctgttgggcacagcttctgactagtaccaagaactgctctggatgcaaggcactgtggggagacttcgtggcacaacagctgagcatgtttgtgtgaactgaatatccacggtggtgtcaccagtgcatccagaccagcagtagcctcaccatggcagaggacaggatgcaagagcaacatgtggccacgggaagcagcaagaacagactgccatacttttgcttcgacctttatctgttgttagaagcaaaaaccacaccctgtgtggactgaatacaccagcaacctactgagacagcgaaggggtgcctggagaaactccaagcagcctgcccactggggtggagccacagaagttccagccctttgcagcggtgaggagccgggctcctcctcttcctgggtggaacctgggattccgacaacccagcgggaagtgctctagcggggattctgggcttgtgagagtccctgtttacccccctttcttccttttcatccattaaaaccctactttactcaccattcaaactgtttgtgagcctaaattttcatagccgtaggacggacaaggaccccatcgctagctgaactaaggaaaagtcctgaaacatttttggcctgcaacgtggggactcaagaagcagtgagtgaaatggggactgaaactcttactgttccttctaagcctttacatccctggacttctgagggtggagaaccatgcccccaaccccctgtctcccccaggccttttcatgccttttccttcctttttcgagacccacctgtgagcagcagctccccaccgccacccccatccctgccagcactgggacgcatggcccaagggtcctgcacagccactggctggttcgcagccaggcatgctgccgcagccttccacctccctggtcaaggggttcagctccatcagacagtaaataagcttttctcttggtggagggaccacttatctaagaataagaggttcttccccaggcatttttaaactgttcttttttctttccccttctccattctgttggcagttaacttttaaagtttttttttagatgttttactaggccaggcttcacccagcaactgggtttccttttgcctgtctgtgtattgtgtgtaatgtctgtcaaaagagctctaattattattgatggacatttgggttggttccaagactttgctattgtaaatagtgctgcaataaagataaagaaaatgtaacacatatataccatggaatactatgcagccataaaaaagaatgacatcatgtcctttgcagagacatggatgaaggtggaagccatcattctcagcaaactaacacaggaacagaaaaccaaacactgcatgttctcactcataagtgggagttgaacagcaagaacacatggacacagcaaggggaacatcacacacccgggcctgttggggagtcaggggcaaaaggaaggagggcattaggacaaatacctaatgaatgtggggcttaaaacctagataacggtttcataggtgcagcaaaccacaatggtacatgtatacctatgtaacaaacctacacattctgcacatgtatcctggaactaaagtaaaattaaaaatttttaaaaaaaagtcaacaagaaaaaaaaaagctgtaattaatttggccaaaagaaagacaattgcttggatctgatgtttttaaagggaagataaaatctatggtacctttcagttcatgtgactttaatctttaagaaataaaaacacccctaaggactattagtaaaatgcaggtcagatgcaaagttttctaagtgttgtgagtttacaaactgctttttgggttttgagaactatttgacttgctggcttcacaattggtaaggcctggggactatggaactaactatgccccttattatgctatagtcaaaccttggttgcagttagcacacaattaaagcaacttaacaagtttcaccttaaagataacaattgctggggttaccattataacaggtaattgagactactcaaaatagatttacatgcaaggggtataagaacagtaaaatgtgctttttctttgtaaaatgttataagaaggcatggaaatataaatttttgcctagggttaaaggattgttttaaattagataagagaaagccgaaggttcaaacaagtggtagaagaactggggaaattaatcttgcagaagaggttctctgggtgaacatattgactaacttcaaaaaagggtattatatggtttttctgtaaattgaacattaaaatataagaacaacaaggtattcttaaaatgctaatctgctccttaacaaaattcaaaagggttataaaaggtttttgcttctttaaaatttctgagtcattttggcaaaataaataatttatggtaatctggaattctatttcataatattaagtgctttaaacatatttaacagctttcccaaaatcaaacttcagtttcaaaattgtcttccctggcacctggttttttgaatacttcagagggcccctgaagtgtctagaaaagagaggtaaaaaggattatttgacatgtttaggtatatgagattgccaaaatgatgctcaatcttctttaggttatatcttggtggataatactaatatatgttccaaaattgtatgggatttctaaaattctaaggtctaagtatatgccataaatcataattaaggttgttatgttaagttattgtaaaacagagataacaaaacttctttgtcaattgtgtgtctaactgtaactaccctggacattttgttattcacagacgattgttgtcttgttttaatcctttcaaaagatggtttataataagctatacaactttaacaggtactttcaaatacaggcttctgataactttagagactgtaacattggaataaaggaaaaagtacaggactcataaagagctgaaatgttcatgaatgtcaagcaaaacaagagttaagtaaatggactgaactcaggaagctaaagcaaatctttttgacttttgcttggaatattgatgatccttgctttagttttttttatagtcaaggaaacttagtttgaactatttacgacctttaataattaagtgaagtatacactcctgtggtcaaaatttggagcatgtttgtttctctctgcctggttcctctagaatttggaaactatctgtcagtattcttatggcaatatagttgtttgcatcagtacaataagaatccatttttcttttgcaacaggacacaattagagaacgtagttattttaccagggttttgactggaagggtatgcttccctttaaggagtcaatcttgacttgcagagccaataaaaatctagtgggaaactggcctcatacccttgtccatgtagtccctgtacagggttcttgacctgtggtcagtaaagaatgtcactttctaacaggtccaggagctccaagtttgtcttgggaccttaagaggagaaaatcacccaactcacgggtatttgacaatacaaacccatggctgggcttggctttaaaaggtcttatctaagattccttgggaaacagagttccatgaaagccaattcaaaaggcctatgtagaaatagttattcttgctgcactttatgcaaataaccaggccaagtataagactaaagtctgttttataaatcattccatcatgatgatatttaacaaaaatgaggacttgcaagagagaaatcacgtttcaaaacttatcatatgcttgtcattaaattctaaactcaccagtcattttcaagttttcacctacattttagatcaaccctacttgttcctgtgaaccaaccactgatccccagctgcagctcagaaagaacaagagggatgggtaatgtagaaatctggatcaatagtctagttctgaacagttatcctacaaatcctgccaggtagtgggaataaataggatgcccataacccagaggtttcctttttgggaaagtaagaccaacgtagctaaccaaagctaagtgtcatccaccgaaatcccagcaagcataactatggctaccagttatctgggtgtgtcacaagacatccattcctctctcttgttggaggagaactcagctccagtttgaccttagcatttggcttatgacaaggagtccatgcgacccccgctgagacacatttttgtctgaaactcaattccaagcttcagataaaaaccctaggaaggaaaactggatctgagggatccagaggcagacaataacagaagttaaaaggcatagcacatgtgagcatggctgatttctaccgattaaaccaaccccaagctttcatgaataaaggccatgttaatatccatagcataaatgaggactaaggaactccaaggctactgacagtagcggagatagtggcataggtgagagtgggtaattcctattctctaggtcctccctgcttcatgggtgcaagtcactttgacacccatggtggcatctgccgaggtcactggaccctggggatgcaaggacagaagaggaaaagaggatgctcttccctctcttcctcatgtactgtgggtatctgctaggaaaagaaaggaaccagggatgcctgctcccctttttctagatgggtagccatttatattcactctgtacccctttagactgcatcctaaacccctgggaatcctttaaaaggcaccttctcttttctcttcctctggtctctcttcacaaataggtaatcatgtctctgtactattagacacttccctctaatgaatcctccaaactgggaaaagttaattttccaaaccttaaacttgttggctcaggatcaagctcagcgggaaaggaacccagaagcacaacatgctggcaaaagggtaaagttcctcttccagtagggcttttggcttccctctccctatgcaaactggtaaaaggccttgggatttttgagctatccttacccctccccttgtttcattttgatacatgttttctaataacgtggtgtatctgttcttactttcaagcatcaaactccaaacactcctgtaaccagagcctctcacatggccccttctactaggaacccttagataggcctctgagggtgatctgcctgctgtttccccaaaacagtgcccccttatcaggcgaaagcagttaagatagttctttgtccctatccttaatctaatggcagttagatgtatttctctagaaggtggtatgagacagccaggtgggagggggtgcctggagaaactccaagcggcctgcccactgcggtggagccatggaagttggcaccctttgcaagcagggaggagctgcggtcctcctcttcctatgtggaacctgggattcaaacaacctgtcaggaagcactctagcagggactctggccttgtgagagtccctgtttctcccttttcttccttttcccccaacaaaaccctccttactcactgttcagatgatctgcaagcctacgtttttatggctttgggacagacaaggaccctgtctttagttgaactaagggtaagtcctacaacactacttgggcaatttagggaaatactttcaagtgggagataatggatttagaggatgtatacacaggtgtcttgcaaagtggatccacttaaggtagccatgtaatgcacaatggtttgagacaaattctatgttgcctcactagaaatagactttactggagaaagaggaaacatgcaaagacaggatcaacacaccaagaacacatggattcccatcctcccactgtctttatagacaggtgtgtggggccgagtgagctgctagatacaaagtgtagcttgctatgctttttccttttagaaagcaagatcatgcttatcaaattcgtcatggtagatgctgaattttaataactgataactttttagttgttattttgagtgttttaatccctcctaatgtgttgctccaaattctaacatttaatagcatgtattaaatataaaagttaaggagatagtgggagaggtagactatatgacctctaagatactttccaactcagcgtctttagttttatgagacactctggagaagtattacatattattaatattttccctaatcttagttggcgttcgattagccttcttcactgatactgcacactgacttgagaacttaaatatatcaatatagaccttttcctcaattctattaactgattcagtacaatataaactgcactccagttgaacatcatttctacctaactcaaacactacaattcaatctcttccgattcttattccatctctcaacctgctggccagttcccatttattttctttccctactcacgccactgattccacaaaatccatactccagctctactgtactgcttactagagatttaataatccccaaatagcaactaagtagacttacagatgtctgtgttgtaacaactgaggaatataaaaggcagcgtgtttttccctagtcataatccttaaatgaagctgataacgtttactgtgaactatttgagattctttctcccctaaataagagggtacattgtcttcccttcagttggtacaccctcaaatttgaatctacagaaacactcactgtttgtgtctatactcaaagcatcttaatagcactggtttcacattaggtatcacattaataagaccactgaatgggtcaaacttaggtttctaagaaatctattatactataagaaatatactggagaaataattagttgcaggtcttggcattcaagaactcacagtataaaaataaaaaataactataatttaatgaaataagtataataaaggaaaaaagtacaattggccttcccaagaatatcatgtagcccccagaaaaaaaaagaaaaattagagtaagcaaccatggcaacaaggcaggctgctggccatttatccaaattacatagatcaatgttagctggcaatcaccgtcagatttgtacatagtaagcacaaaacctagataaggaaaaataatagggggaaaaaagaatcagaattctggtcacatttctcgttagagagctaaagtacatagacatgccataaatgtaggaatggatatgggccaaatattgatcccttcattcttcaagggctagggtgaggagaagaaaggaacttccaggcaagtcactttgtgtctcaaataatcttttatgaactgaacgttcgtgtccacccaaaactcatatgttgaaattctaaccctaaatgtaatgctatttggaggtagggcctttacaaagtacatagatcaagatatcagtagttacctttggtttgaagcaacaacattgatgcaaaccaaacattagcaacatttagattttacaggaagaaacagaaatcctgaacagaccaataacacacagcgagactgaaccagtaataccttaaaaaaaaatctccctacaaaacaaaaaccaaaatcagatggattcacagccaaattctaccatatattcaaaaagaattggtaccaatcctactgaaactatttcaaaagattgagaaggaggaatcctccctatctcattacaaagctcatatcaaactgatacctaagccaggaaaggaaataacagcaaaagagaaaactataggtcactatccctgatgaacatagatgcaaaaatcctcaacaaaatactagcaagctaaatccaatagcacatcataaaaataattcaccacgatcaagtgggtttcatcctaaggatgcagggatggttcaacaaacacaagtcagtaaatgtgattcactgcatacatagaagtactaacaaaaaccatatgatcatctcaatagatgcagaaaaatattttctaaaatccagcctccctttttggtaaaaatcttcaacaaactaggaatagaaagaacatagctcaaaataataaaagccatctatgacaaacccatagccagcataatactgaatgggcagaagttgaaaggctcacccctaagaactggaacaagatcaggatgcccactttcaccacttctgttcaacagagtgcaggaagtcctagccagagcagtcaggcaaaagaaagaagaaaggtcatccaaataggaaaagaggaactcaaactatttctgtttgctgatgatataattttatatctagaagaccctaaagactctaccaaaagactcccagatttgataaattcactgaagtctcaggttataaaaccaatgtacacaaatcagtagcactgctatacactgataacaaccaaaccaaaaacaaatcaagaacccaatcccatttattatagctacaaagaacaaatgaacctaggaatatacttaaccaagggggtgaaagatctctacaaggagactatcacatgctgctgaaataaatcacacaaacacatggaaaaacatcccatgcttatgaatgagaagaattaatattatgaaaatggccatcctgcccaaagcagtctgcagattcaatgcaattcttatcaaaataccaacataatttttcacagaactaaaaaatatcctaaaattcatgtggaaccaaaaaaagagcctgaatagccaaagaaataccaagcaaaaagaacaaaaccagaggaatcacattacctgacttcaaattatactacaaggctatagtaaccaagacagcatggtactggtataaaagtaaatacatagaacaatggaatagaatagagaactcagaaataaagccaaatacttacaaccaactgatcttctacaaagcggacaaaaacatacactagggaaaggacactctattcaataaatggtgctgggtaaattgaaagccacatgtaaaagaatgaaactggagctctatctctcactacatataaaaattaactcaaagttgattaaatacttaaatgtaacacctgaaaccaaaaagcctctagaagaaaacctaagaaaaactcttctggacattggcctaggcaatgaatttgtggctaagaccccaaaagcgaatgcaataaaaagaaataaatgaggcctaattaaactaaacagcttctgcatagcaaaataatcaacagagtaaacatacaacccacaaaatgcgagaaaatatttgcaaactatacaatgaccaaaggtctaatatccagaatctacaaggaattcaaatcagcaggaaaaaaatgataccattaaaaagtgggacatgaagagacgtttctgaaaagaagatacacaaatgaccaccaaatatatgaagaaatcttcaacatcactaatcatcagggaaatgtaaattaaaaccacaatgagataccacctattcagtcagaatggccattatttaaaaaatcaaaacacaatagatgttggcacagatgtagtgaaagggaacacttacacaccggagattggaatataaactagtacagcctctatagaaaatagcacggaaatttctcaaagaactagaagtaggtcttccattcaatctagcaatcccactactaggggcatccacccaaaaaaaaaaaaaaagccatatcaaaaagacacctgcacgcatatagttatcacagtacaattcacaattacaaagatacggactcaacctaagagcccatcaactgatgagtgtataaataaaacgtcatatatatacaccatggaatactactcagccataaaaaataatgaaataatatcttttgcagcaacttggatggaactataggctattattctaagtaactcacaaacagaaaaccaaataccacgtgttcttatttataaataggagctaagctatgggtacacaaaggcatgcagaatggtataatagacattggaggctcagaaggagttttgaggcggagaatgagggataaaaaaactacctattaggtacaacatatactatttggatgacaggtatcctaaaagccaacttcaccactatacagttcatccatgaaaccaaaaaccatttgtattcgtaaaggtattgaaataacaaattaaaacaaactaactgttcaccaagctcccacagtcgtgtaaggtcaagtccctggaacaactctcatctcctatagcagctctcactgtttcctctgatggaatcccgactgataactaggggcatggaagaggcatcctgggcactgggaacattctacttattaacctgatggtagttatgatggtgttcgcttagtgcagatcaattaagctttaaatcaatgttttgttcaattttctctatgtgtgctcaatttcacaatagatgtttttaaaactcaaaaaaataagattttatatttagtactggagtttgatcatttttctttgtaaacttcttctgaaggttaggatttacgcagatctaaaaaaagacacttccactctttacagtttattttttatatttaagacatacctggtttatgtttaatagttgataagtagatatagactagtgttcttgattcaaagaaaacaaagaataccgtggagtaatctgattctgaagtatctttggtcatgttgtaactgctgagtagctcacgtctttcatccataaaaaagccactgagtgttatatttgtgtgaagttggaaggagaaatgtgttgattctgaaacattcttttggggggcaaggagaggaaaaattacaatgaagcagaattttttaagagaaatatctttatccaaacttaaagcacttttcaaacagcagctctcctctttctgataaactaagagcacttctcagaagtactctgtcaaaaaaaattattttgtaaacagttttccattaagtggtactcagctgcctggaggacccatcttcagtgtgcttgccacttccttctttttgacagatatccaggttgcggtgacagttgcatacagtatcttaatttcaggaagagatggaattttccaaaattgactaacagtgaggagtgggaggttgctccaattaagcactcggtcctctctattgtattaaatttaaatgataaaaatattgtaactggtaatttggaaactgtttttaagtatagaaatgtctttgtctaaaactcttgtaaatcattaataagaaattaaaacatcccacttgagtacctttatctaatcccatttttccttcaagctcctcaggcttctgccaacaaagctttccattgcattgcttatttctattttgccaccattttttttcgcttgacctcccttattaattcagtaaagactgtaggccatcttccagggtatgtgctagaactacagtttaaaagatgagtaagcatagtacctcccttcaagaagcttgtggtccaatggagaatgctctgctagcccatttttaaattattgcagttcatttttacatgtctaaaattattgcatcaaatgtacatactgcaggaaatctttcccacatgtgtattttatctactattatttttggacgcatggacaaacaattcataattaaaagctagaatttcctctgatataagattttaaatgaagatacattaaaacaaaattagtacagaatttaagggctggaagaactctataaagaccttttagtataatgttcttatctaactgatggaaacactaatgcctagagagtgaaacaactttatttactcaacaaatataaatggagcatcaaccatatgccagatagtaaggtagaagctggaaatatagtgttgattaggacccacattactcagctgtaattagcaaataattaaattataataatcaccatacatgagaagtacaagatgctgaaagaacataaaatagggtgatgaaacccaatctgtagatgcaagggctatttttctcagagggtctcattaaagatggaacttaataggctgggtgtggtggctcatgcttgtaatcccagcactttgcaaggatgagatgggcagatcacttgaggtcaggagtttaagaccagcctggccaacatggcaaaaccccatctctactaaaaaatagaaaaatgagccaggccaggtggcaggcacctgtaatcctagctacccaggaggctgaggcaggaaaatcgcttgaacccaggaggtggaggttgcagtgagccaagattgctccagtgcactccagcctggcagcctgggcaagagagcaggactccatctcagaaaaaaaaaaaagatgaagatggaacttaataaataggaggctcaccccagattgcacaatgagtgagatgcgcaaatggaactgaagtcaaagtccttatagcatgagtggcatatctctgctatggcaagctcccaactggtagttatttatggtgcacgaactatgagattatgaatagaaaactgtcaatctcattgacagaagactgtcaagaagaggtgagaatataagctcacctctagtcctgcctgaccagcctgctcaaccttcaataagagtgttgaaatatataacccacatttctttgatcaagaagaattattagcatatgttcaagtttctaaataattgagacttgctttttagttaggtatctttaatgccctttatgcagcaaataaattattattatataaagtttgttttgcaatacatattacagtggaagaagtgcagtatatttctacattaaatgtgtgaatttttccaattatttctttcttattgttaggtcttgcctctcagtggcatacaagacaatccatttaataatgccaagtaaggaaggagagttttagattaataactcctgtaagtaacctatttgtcactaatataaccattttatcattgtctatctgccctggtgcactgctgactaacattattagtagcatgctttgcttaggagaatgtaagaataactaattttgtggttttcccagaaatatttgttttctccagcttttattggtatccagataccactcgttctaataaagcaaagccctcagtgcttttcagaagcccctgaagtgtgtgtttggttactctttacgtgattaattttcccttgttagttgctgttcacacacacgtatgtattcacctgtgtatcactaccgcctttcccctgtccattgtgtgattgctttaaacaagaaaaaccaaaatacatttatttttagagtttaataagaagttattcaggaacatacttataagtactttagaaatatttgaaagaacagtaagtaggtagagaaaataagtggttaggcagccagctctctgactccttaatccctatatttattagaccccattttctgcatactcattcttgccctttctgcattctctttcttgccccatatactgatgcagaatagctagcccactagaactcccccctattattttaggattcctcaataggtatctcatgatttagcaaaagttgttctcttctgctctgtggcagcagcatttcttcaccagctctgacccccttctaagagtggtccatcctccactctccacaatcccctgagagctgccactgttgttggtgtgcgtgagagctaaatctacctaaggtactttcctcatgactccaaagctactggccacctcctggcaatgacattttaacataagattgcaaaccagacagaaaaagtactatccatgcattattatccctggagctattcctcatcagagaaaacaaaagccaggctgaaactcaacaacttggagatttgagggttctccttcagactgaatcaatcaccagtgacagagcagggactttgtctcattcccaagtacacagacttccaggcatcacactgaggtgtatttactttcaattgctagatacatgctttaagaggcagacacaagaaggatccttttcagttgataaattcaagagcacaatagcttcaatgatctcaccttctctaaacacatacttttaattgacaatgattatgtatccaggcaagttttccagaaaaagaaaatccattctttaaactttgaaggctgtttccttcttatttactgtatttattatttacggttaattatcatgggtaattcctcctcctttatgagtatgttttacttgaatttgatgagccatcccaacccaatatatagaaataaattagcaacttctctaaatataaaaagtctcattcaaagccaggaaacttcaaaactaaactagataaatgtatatacccttagtagttcccaaagcatttctgaattatggtacctttcttagcactgattccttaccgtataaatgcttatacacgtttattttcccttctatactatttagtccctttagatcagagatagaaattatgtattattatatccctactgtactaaatatctgacacacaataggcactctctaaatatctgaatgactgaatgcatgaatggagagtgagcaactaataatgacagctgtcctctatttaagacataatacatctcaggcactgtcttgggcaattttcataaaccatctgatttatttctcatgagatcataagggaggctttattatccccaatttggagatgagaaaacagctgcttagagaggttaagttccttggcaaaggttacagatcttgtagatgatagttttaattttaactcagttgtttcctatgtaaagcttacactcttattcactaagacaggggtcagcaaagaatggtcggcactgtttttgcctgccaatattttagcaaagacagttttctggcgactcggcctcacccattcatttacctattgtctatggctgttttgaggctacaacagaaaagttcagtagttgcaactgaaataatctagcctgcaaagcttaacatatttattatatgactccttacagaaaaagtgtgtgggctgggcgcggtggctcacgcctgtaatcccagcactttgggaggtcgaggcaggcggatcacgaggtcaggagtttgagaccagcctggccaatatggtgaaaccctgtctttactaaaaatacaaaaattagctgggcatagtggcacgcccctgtagtcccagatgctctggaggctgaggcaggagaatcgcttgaacctgggaggtggaggtttcagtgaacctagatcgtgccactgcactccagcctgggcgacagagcaagaatctgtctcaaaaaaaacaaaacaaaacaaaaaaaagtgtgtgacccctgtggtaggatatactgaataagcagaccacagcagtcagaaaaatggtgaaggaaaggcagggaaacctgcgcaagtgagaaacttgttctctacatttgctgaacccacaattgtttcctactccccaccctaacataattgaattattgtggcattaaaaagtacccaggcaaggccttagtttaaatctaaccagccttacattaacctggtctgtctgtgctgttgccttagctcattttcttctctgtttggtgctatgactaactcattcccaatgaagcctctgatatttcaagctgagagaagctaaggagctgaaactcttgttaaacaattcattagcttttcacagggcagagataaggtgatcacattcttcaactcacaacataaagtgcaaaagtatttcagacctagtgagcctttctctttttccttaattttcccttatccttttctcctaggtgtttctttctcccctccctccatctctccacttaattgttcacatgtaaaccttactgaaggtcaagtatatattgcattaattaaataaaatccaatgctcttttcttaatattcaatcaggtgtttaaatacattacatataatatatgttacataaacaagatattttgtccagacaggagtctggaaattgattgcttttgttggaaagacttatggtctttggatgatgtgtgggtcttccttcccatagctcttttcatccatgagtgatgagttaatagtagattaaaaggctcccaggagagaatgaatttggactgcactcccttttgtgtgagatagcattaaaacatttctgaggtttttagataaccccaaataaagccaaaaaggcaggcaatagtaacctccatgaaagagggatcatgttgaattttttcactactgtactctacattgcctagcgtaatatctagcatgtaaatatttgtggatgaagggaaggtgagcaggaaggaaagaagtagagaggatggaagacagggaaataaatggaaggaagaacgtgagaaagaaaaaaaatcatacttagggcacgatcactgtatatggagtgggcggtgtaggctgatactctgaacctagcatctgtctgttgaagaggaaggctactgtagtcacagcagactggggctgatgctagaatcctcttgggtccaaggactcagcttcaggaaagtggcccactttgtgtattatcacacccggctcccagtgattcttgctgtaacttgtgtctttgtaacaggactctctggaagagaatatcctccttcacactttgatggaccaaatttcagggggagtggcagagctctgcacttgggacagaggtgtcctcaaggaatgcactaggttagcaagagaaagggccttgattatctaccatagctgtagacctgtaagacttcaatggcaccagggctccatcggaggcagtaagtggcctacccaagagcaccttctgaaaagtctggcttgaaggagtataatggagttgcatctctccagcacagtgtcatagatgtgtagcaagacagacaggctcaggattaaatgtgaccaaaactgcagattctagggattatctgggtaaggaaagcctgggtaaagtctagattttctactagtttaggagatgggagcccgtacatcttgtgttctgtgtattttgtttgtattattttcttagccacaagttgttgaagtctgaaaatatggactttcatgtcatccttcattaccttccacagtgtgatctcagaggcaagcaatgcactagcatctggcctaatgtgttactgatggcagcggtgggccatccagagcagctgttgccattacacctgctacagcaaggaggcacaagtggtagcagcaggagaggctgcagggcagcagtggtggccatgggacccctgtgccctgcgtccccaaggaagctgactgcactgcccccaccttcacgcagccgggcagtacccactccaggccccggccccgcttgccactcttgacagccactgctatggggagttcatggggaagaggcgaatagtccctagagacttcccctgggggaccccctggagcctaccaccctgggggccaccatgatggggccgggccaagttgcctacaggcaggggaacaatgtggttgggcacagaggggtgaccagagaggggactcgaggcggagccgggcctggggtggtaccatgcttcagggagcctgcaagagccctggacaagcgggagacccaccccctctgagttagctgggtgggagctccctgggtgcagctgcagctgctctgccccatctctggacccaggcatctctgtgttcctgggggcccaggaaggcccctctgacccctgcaggcttggaggtgcctgcttccactgcctggcttctccccactgtcagtgtatgctctgatcttggagtaaggttggggccaagcctgagcactgttgcagtttggccaggggcatatgctcagggcagcagtgacccaccaaccccttgctgcctcggctccctctaaactttggctgtggacaagcacaggagggaggcacaaggggtgctgaggacagcggggtactggcctgcaggcgccccttggcatgaacggtctgggtgcgatgaatggtgacaggcggcagacaggctcctgggcagaagggggaaggtcctcagtgatgccctaccttcaagctgaggagggcctgaaccctgggggctgggagccattcccgcataccagaaggtgaactcgtagcgcttttccctgggccctcgtgggtgcccatggactgatcaacatgcacttcctcccctctgaggcccataaaaacccccagactcagccagactcaagcagaggacagacagatgatggggagatgaccagatgacaagctgcagagaggagctgcccaccccagggtctcctctctgctgaaagttgaggagacaatgggatgaccaaatgcagagaggagctaccctctctgctgagagatgaacactcactgggatgccctggctacagagaggagctgcccactgagagtctcttctaagctgttctattgctcagtaaagctcctctttgtcttgctcacgctccacttgtctgcatatttcattcttcctggactcaggacaagaccttggtacctgctgaatggcaaggctaaaagctgtaatagaaacagggctgaaacatgccccttgcttgccacgttgtgggtgaagagaaggagagaaaagctgtggcccttcagggagcccagctctgggagctccctgagccagggcagtgactccctatttggggccctgaagttcctgacatctccaagcttccaggagctactgcattcgctggtgccagctggagaagctgtttgcagtcctcctggtccagctgtagcctcacagagagccagcacccacactggcacctggaactgcctgccccgcagcagcagcagccagtgtgtcttgctgtgcacactggccagaccccacactcactcacactcaccactccacgcctgactcacagtctcccttggaggcataggatccaggccagtagtgtaagccaagtgcaccctgccaggccaagtggacagaatgagcccagcaggcccagtgaaaattcaggcaaaggtgccaccagccatagaggcttccagccagaaaagcgacaccccacggatcctgtaacattactatttccttctatccaaagatatgtgaaaaaccagcccaggaattattgacctgtcttgtccctctcaaggtgcctgtcaccctacaattccagtagcttgcgtctaccagtttttatctttttataatgcttttaaaatataaaatacaatacatacacagaaaactgaataaaaccaaaccacatgtctcagtgaattattacaaaacaagcactgcgtgaccaccacacaggtcaggagatgcaatacggttggcacatctgggggtcactccccaccacacatgtatgtgccccgctataccagctcccaaccacaaatctctcctcttgatagccactctgacttttaagataaactttgtcttgattttttaaaatcattttcacctaacagtgtattcctaaaccttttagtttagtttttgcctgttatttttctaactttacataaaagaaatcactttatctccacttgaactttatctgctaggccacttttgagtttgcttgtgagaagtatctccattgttatggttatctgtaattcacttattttcattgctgaatagcattccattgcatggacacactataacttatgtatctattctagtattaatgaatatatgggttgtttctagctttagctattatgcacattactactacaaatatgcttttatttatgccttgttgtaaatggatgtgtatttccactaagtatgtaaccaagaatggaattggtagatcatctggtatgcctgtcttcaaacatagtagatattgcctatctgttttacagggtggtttaggacactacatgcctcacaacagtgtgcaagaatcctacagcttcagactcttgccaagacctgatattctgtttcctttaaatttagtcatacttatagacagatgttgctatcttatctttaacttgcatttcctagattaatagacctagatttgcatttccatattactggacctaacttgcatttcctagattattaggaccattttaacttttcttctttgtattggtgaagtaagtccatgttcaaatcacaagctcattttttctattgggttgtatttttaatactcattgatttgtaggctttttaaaaaaatagccattctagaccatatacaagcatttcaatcattatgtatattgcaaatatcctatcacattctgtgtctttgtttttcactgtctgaatgcccataaaattctcatatccagtaggagaagatacatgtaaataaaacctttgtgccaggttctctcatatacgtatgttcagggtattaagaaatacagagaaggagttgtcaattaaatgtaggagggatgagaattcaaaaaaatgtcatagatgggtaaagtgaatattggaaacatgcattcatatttttcaggaaattaaaggagcaaggatctctatgcaaaaaagcactctgagtcctctgaagccctatttatgcagctgagtgagagagcagtactcttgactagagaaatttttcaagggaggtcggtgatgaatagagccctaagtataattaaggaaaggtaaaagaggtctctggggtttagagacatagtttcgcttagaataaatattcccagtggtttataaaaagagtgaacagaagtatagttgtcttggggtggagtagagctgagctagatggcaatgagagtgagtttaggaagttgcagatagaaggcaaaaaataccagaagtttggcaagtattataggaaatagataacataccagctttagagtcacagagatcttggtttaaattctgcccctcctttccctattttctctctctctctttctgacacacacacacacacacacacacacacagagacacacagtgtctatggcatgtaatgcagacttttcaaaaagtggctgggaatgctttctctcagttccctggacaataaaataactcacaatgagagctctcgcttttcctctacaaaaaaaaggttcacaccttttttgatggtgttacagtgctttattcacccgcaaaggagcaactgcatctttccattggttccaagcttcccaggttttgagcagctggcttcctcagaaaactctggaaaacagctgacaattatacctgttatacaaatagcctgtctgcagagtctcttcttcttgctctataagaacagagaccaatcacaggcaatgttgctttaatgtaatataaacccactatgtatccagcaagggactggccctggcttacctctctgtgggaggccaagaggcttcaggaatgtgtgcctctcttgctgacaccagcctataaatttcccccaataaagcctgttccttaaccaaatgattctgtggaatttgtcttgagccctgtgcacaatggtaacttgagacaagcaacaaccattcttagcctcggtatcctcatctgtaaaagaggaattatgccaacaacaataagttattgtgaaggctgagcaagataatatatttaaaatgttttagcactgggcctattttacatggctaatagaagaaaatgtacttatggctaaaataatgaaagctgagtagcctcaatttctcaactgaatgataatgttatggcgctgatctcaaaaaaatcattcactagataactgaagactgccagtagagtgtatgtgtgtcaggggtgagaaggttgggatctagggggtggctggaaaggattttccaaaagagatttgcggaatgagagggactggccagaagcagatatactctgccaatttatctcatcaacaattgtagattgcattttcacttgtaataatgacccaatagctattttaattatgtttatatatacatatacagtttatgtatataacaaatatataagcagaagcttctgcatgaccatgggtaaaattgttcttatgctactggactcagagaggctatatgtttctattacagtagttggactgaataaatacgttctggcggggagggtctgttttcctgtgtttaagctgtaaagtgggagattctctatagagcagattataaggaagttggcccgaggatgacataaaagataaactgtgtgtaaataaagtagtcaaagcaaactaaggtttccagggctaaacttcttgtgttggagctgggaattgcttctgattttattcctactgctactagtgtcacaggatccttggagtgttgcttttctggctgaaaacctctgtggctgatggcgcctttgcctgagttttgctcgggcccgctaggctcattatgcccactcggcctggcaggctgcgctcagctcgcgctactggcctggttcccacgcatgccaagggcaaggcaggcacggagtggtgaggggtatgtgagcaagcaagcgtgggatccagcaactgtgcacagccaggcacgctggctgtggcggggtgggcagctccaggcacctgcatgggtgccacctccctgcaaggctgtagctgaaccaggcataccacaagcagtttccacggctggcactggggaacgcagtggtgcccagaagcttgaagacaccaggaaccgcagagccccaagagtgtgtcacatccctggctcagggagttccttggtctgggctccccaaagggccgcagctcttctctgcttctagtagaccacaacatggtgagcaaggggtgtgttttggccctgtgtgtgttacagctctttcagccccaccatttggtgggtctccagttcttgtcccacatccaggaagaatgaggtacgcagacaagtgaagggtgagcaaggcaaagggtgctttactaaacaactcagaggagacctgcagtgggtagcttttctctgcaggcagggcatcccattgtctgctcagctctcagcaaagaggagacccataatgtgtagctcctctctgaccaaatgatggtcagctcatcatttgcctgagtcgcttgaatccagggtttttatgggcttcagaggggaggtagtgaatgctgattggtccatgggcagccatgggtgggcccagaaaaagcacggcaagttctcactcctatctgcagaactggcctgaaggcggggtttcaccggggaactgcccctttccacccaggagcctgtctgcctcccattgtcattaacctgccatttacagtgcccatggcgtccaggctattcatgccaaggggtgcctgcaagccaacactgagctgcccttagccccttcttggcctccctctcatgctggtcagtgcccaaagtccagagggggctaaggtggcagggggctggtgtgttagtgctgccccaagtgtgcatgcatgcacctggccaggttgcgacagtgcctgggctcagccttaactttgctctgaaatcagagcaggcaccgggagtggggagaggccaggcagagggagcaggtacttctgatcctgcaggggcaaaggggcttcccaggcccccaaaagtgcagagatgcctgagtccgcagccgcagctaggtcgctgcagtggtgcctgggggagtgaggttcctgcccctccaacttggaagggggcagggcttccatctgttcctgagagggctcagccctggccacacctcccctactgcagccagtgtcatggcaacagccactccagacaggccgttgctgttatcattagagctggccagaagaaccaacactttagtaatgagttaagacaatattggaggaatgagagtctgtttgggcccacctgaaggcataatactggggcccccacaaggatgaaagtaagcatgcaagcaggagggtaagagtggagcagataaacttcagtgttgcccttaattacaaacgtagctggctgggtgaaagagacaccaacccctaaaatacacctgacagatctgctcactcaaggaattctactcagtgagaatttaatcctggtagactacctagatcttcgggcccttttaaatgcaaatgacacaaagaatgacagaaacctcattgtaaacttacatttaggtctgagcatgaaggactgtatggagttctttctcaatggcaagtttagggtaggatggagggaagatcagagctttggaattctgaaggagagggaaacatgctgaaaagaaagagaactggaggggaaagccaggaatagaaaagaaaatgttgcccattcacaatgggaattaagcttttcctataataaagaccttgacacagaagtgagtgggctaacgaactttctccatccaacagttagttctatgtgtatcactaaagttataaacacattcttgagtaccagaattttaattttgataccacaacctttgaaattctactataattgggtcaaactctggaacagtagcagatatgctgacttgctatagaatgagagtgacaaagaatgatgaggaaatgcctgaggttgagtcccaaagtactctaagtgtcccccaccaaggacagtgatgactaaggccctctccatgtccttgatgtcaacattagatgatgtgtgttaaaaatgttgagaatggaggggactatcttcaggacatggcattactctccacatggaaggtgtgttcaatatgccatcctgggaagattgaattcttgcagcagcacataatggaaaaatactacagcactaagcagtaaactgagaatatatcagaatcccaaagactacatctaatattgcttaactgtagaatgtagttatacactgttctgactggaaaaaaaaataaaacactgcaattttttctcttccctattgaggatgagttccttactaacttggaattcagttaaggtttagtttaaccaaactattccttagggagttgattcctatcaaaggtcaaatcctgaaagagtaaaataatcaccttccaaatatcaatcttgtaaaacagaaggaggatcagaaaattagtaggttatactttatgggcaatttctcttcacagcttaatgctttgtttatataactatccttattaaattattttagcaataagaatggtgttgccttcaccccacttcactctccaaaccctcaataggaaaaagttggctggaagagtgaataacaaactaatcgcctcaaacttcactaagattaactggatatgtcacctcctctaaagatcacagcagtcattcactggaataacaaatggcaagacgggaaaccaaattgtcaacatgggtacaaagaatctactaatttgcttgaggttagtgggtaataggcagtgttatactaacattattattcctttgtgatacatttccaaccaaatttcttttattagaaatgcttttttctgattatgaaaataataaatgctccttatgaaaaatcaaaaatatattttaaaaatacaagaaaacaataataattaacaataagactggcaaccacagatgatcattgtaatgaattagcattcttctttcagtgttttggtgtatataagtacaatacattacagcatgtaggtgctttgcagtttatgtgtattagcatggtctcattttgttaaattattataagcaacaatattaatgcctgtattatattccaatctattgacatttatatatcctttgttttctaacataaaaagcttttaaaataggtacaaatactttttctaaaagttttacattacttcttagggtaaaattcttggaagtagtgtttctgaaccaaagagcaagaagaaaatattttgccgaattattttctagacagttttctttgttttatagtttgtttaatcttttgctgggcatataaaatagtagtctgatctctgtgccttcttatcaatccaaaatatttcttctcaaagtattttctatttcaaaagatgaaaaatatgtctcaagttatgtttcatttattacatctaagtcttaatcattttcataaatgtatcagtcaaatgtagtttctttcataaattgttggaatatgccctttgtaaattgctattttaagattttttaagataggtcattagaaatttgtatgaccattataaatattcaacgtattaaacgtttctcttatatttgaggcaaatatttctcccaactatgtttttcttatttatttataagaaaacaaactaaactatatatagttatatttattaactaaatataaatagttaggtctatttatatttccctatgtgattctgactcaattcctctacatttagaaaaattcctccccctctacagattagacatgcaccatctaaaacatagtacttgctttttaattattattgttagaattaaatgaaactgaaacttgttaatgaaattagctaacaaaattttccactgctgaccagatattataaaaaacattgaacctatcatgtttaatagtgcatagattttcccaagctggataactgtgaaatagagtgtaaccaatgatttgagtgtaactgtgattaaactttccaatgttggaagacacttttaatggaagctattatctatatttatagcagtttcattttttacttcagctgttacttactcaatttttttcttctcttttttgcaattgatttgcaaaatattccattaattgccttataactgttatacatatggaaaattgttagcatgccttaaagtgatcaagaaagctcttgagtgttgaaatatactaagtcttattttagatctacatttctcctctgggttctgcttaggcaaaactagttacatttaatgacgctttcatgcatttgctattaaattatattagtctaggtcagtcagaaccttgagatacgtttgtctcttgaggctccttgtctggactagatgtccatgcaattcttgttcagctccaagtccagccagaggcatttaatgtggccaacaacaatggtctcatgccttgattctaacatgtatctgggggtctgagcttaagaatggagaaacagaatgtaagtggtcctgtcagttgttaaactactctttccctgcatccccagtcttgcctcatagatatcctcggaataaaatatcatgatttttaagcatctcagtttgtactaggattgcattgatgggtggcttttccaacagaggaggaatagagatgggagggactgagatgcctatattcgagaaaaactatttctaggcagatagccaaatcttgatccatcaaaatactaaattagtaatatattaaaacatttttaaagggaattctgttattattatgaagaaaatgagaaaagaataatattccatactgatatcttctatcatttggaaatacctactttcttccaagaactgtataatgtactagagacataagattaaaatatatggtccctgtttccaaatagctcatagcatggagaccaggctgaccaggaaacagtatcagctatgaaacggaagtactgaattacaaggagtagatggaatgactgcctagctgaaactgtaaacatcaagaagaattcctggataatgtgccctatgaattgagttttacaggaagagaatctcaggcagaagaaagcatattagaaggcccaatgctgtgagaaataacctatttacctccctgcaagtatttcagcaaaggtcttaattggtcagtgacaattaagtaaaatgaagggcttaggaggtccagatgattaaggtttttattcggcttgctaaggattttggactttatgctaagccaataaaaaggtattgaaagactttaagtagtcaaggatgtatgatcagatttgcattttagaaaaatttctctggccacaattacgtaaaaaacagagaaggatggggcgggggacacattagcacaaaagaatagttagaggacaattcttggccattcaggaaagaaatgaggagggtcttaagtagagagagtgtttctgaagaaagatattaaagagccataagaggcaacatatgatcactgattataaggttggagagacagggataaagaaaagggtgaaggcaacccagctttctggcttttacaaccaggtaaaatgtgatgacgttcacagaagcagggagtaacagtgtgaaagaaggcttgattgaaggtagaatacaaatagcttgagttacctgtgaaatgcacaagtggatacacagggctgggactagggtgaagtgagtgatgcatggaattggatgcaaaatttaagaaacaaaaactctttgaaaaaatgcattttattttaagtctgggatacataagtaggatgtgcaggtttgttacacaggtaaacgtctgtcatggtggtttgctgcacctatcaacccatcacctaggtattaagccccgcatgtattagctatttgatattgatgctctctctttccctgccccctactcctgacaggccccagtgtgtgttgttcccctccctgtatccatctgttctcatcgttcagctcccacttacaagtgagaacatgcggtctttgattttctgttcctgtgttagtttgctgaggataatgacgcagtggtaacacatggaagcctcctttctttaaggaactattactgagagagaggcagaaggtttaaaggttgtgtttttatttatttatttttacttttctctcatgaaataagaaactggaacatgtttatttgctgaggctaaaaggaactggcaatggagaagggacgtgggaaggaacaaatcagagaagatagatgccaaaacaaagacagacagaggctgaagaaaaggaggctcagatgggattattgtagacagtttactgaatacaggccttcaaaactggggggcttccacccaggaagtgaaaccatatgacccagcaatccctcttctggttatacacccaaaaggaagtgaaatcagcaccttgtagaaatatccgcacgccaatgttcgttgcagcactattcacaatagccaagatatgaaagcaacctaagtgtccctcaagggatgaatggataaagaaaatgcataatatatacaaaagagaatactgttcagcctttaaaaaaaaaaagaaaattctgcaatttgtgacaaaatggacaaacctggaagacattatgctaagtgaaataagccaggcacagaaagacaaatactgtatgttctcacttatgtgtggaattaaaaaaaaaaaaaaaaagtcaagcccatagaaaaagatagtacaacagtggttatcagggacaaggaggggatggggaatggagaaatgcacgtcaatgggtacaaagttgcagttacataaacaactgaaataagtaagtctcaagagctaatgtacagcatgaggactacagctaataattttgtattatatactagaaactggctaagacagcagattttaggtgctgttaccaccaaaaaataaaaaagaaggtaattacgtgacatgatggatatgttaatgtgcttgaccttagtatatttcactaaatatatatgtaatatacatttatcaaagcatcatgttgtatgccttaaatatacacaataaaagaaggaaagtaatgcacttttattgcctggacaacacattaacacatctccccattgtgggtcatttttttttcttttgaaatgtttataacatttactcacatctttccatatttctgcccatccccaaatttaaggaaattagtatgcaatacttatctgcctgtaatcccttctctttggggcattaatcagcagttactaatctgaagatttaacaagggaagaacaaagaagcattaaaaacactatttgctgaaaatatagaaggggtgcctaagtgttgctcacatctcttcaaccttcaggtggaaattatactcaaggctgcaatggctggaaccccaagttcactgaaatctgcatcttgaaggaatttttgcacaaaacagttctttcatttcagaaataaaatatttactaaaaagttgagaaacaatgcaagcaaatgcagtaaatatttgttcttcatggaagcaagttattcctttacatactcctattgtctcagtgaagttctggaggtttatacaaatggaatagattgtggaactacccctgagaactactcttaaacatgctacgtattcaggatgtcaaattaaaggagtctctgaggctgccgcttctctggtcatctttaattagacaatactctggtgaaaccctcacaattaatattaagagttgttcttcttctacagtaagtggaaggggaattatgtagtggcttgttctttgttataattttattgagagggttgtggaggaaggattggaatataatagaattgttctattttctaccatttacagaaaactagatgaatcacaaaattgaagaaaaaatgatgcttatcttttaaatatgtattttataaatatttaacttatattaaaattactttccacatattacaaaatgctctaggcatatcagtgcatgtgtgctactcattaaatgttactatgtctttctaccacagagatttatttaggagggagattgtcatgttatttcctatacctggaatgactcacacttctgtgcctgttaacattttatccatctgatacaatctagaccgtgaaacctttcctaatcaagctattttttcataaatttaacaactgtcataaatgaattgtctgtcatgaatgaatgaagcaacaaaacaatgaatgactcagtgtgggttggttctaagagttgcataccttcgtaaccccaatagagcttgttggggtgcctggaatattaacaagccaaaaaaatacttactttattattaattatgtaggcaatgcataaattgaaatacatttatatttctctcaagaaattctctctaaattatattagcttctgaggagaaagtgtctttctagcaacctggcttttaaaaccatcataggcactttctctgtaaaggtaaataaactttctttggaatgtggtgaaagaagctgttagataatttctgaatgtctggttttataataaggagggtcactgtcctcaaagtttagcaatcactagaccctgagggacttttatctaatcttaaccctgcacctgactgccaggcagagctaatcacttaacctcccagtgaattaatgggttcatctgtaaaacacgattgccatcaaaggcatgaaaggaaaagactaatgatagacggaatgaggttagatttaaagattcaacaaagccatcaaaattcacagcaaagccattttccattatttccctcaattgtaactatactgcttttataagaagtgaattcgacaaaaataagtttataagagttctgttgtgctagtttttatctgctggactgatgcagtatgtaagaaaattctcttgctttcaaaaatgtaaaatttaaagcacattgaaaattcatgatatttcatgagatgcctaaggatttgagactctgacagacaaaaaaatcccctgtgattttgataagactgctaaataaaaaagcagttcatacattatttttatcaccttcctcttctatttcctctttcatttttctattacattttgattttgacttttatgtttctgcatctttacttttctccacccctggagcaatgggaagtatttttttgcaggctacaaggtaccattttcagtgtctgatgaagttctccctttggtgtgtgtcaaacaatcatttccagcctccagataaagagacagagtggcccagaaatgccctaagcccactagaggcatgcttgcctaagctggctgcatctctccagttgcaatgcacattttttgggacaataataaatactggctcaaaagagaatgatggaaagtacatttttaggagatatgagatctaggtctattgatggataaactgatttttttccagtcactataacatctgttcagagtaagtaagcatcactgcacagggagatggaggatgttaactgatattgggactacaattagatagaagaaaaccagaaccaaggcacacacactgttcagatagttcatagggttattttaatcactgattcaactttacagaatgaagtttctccattcaatttcacatcagtaactgcaggttgtattatgtctaagattggtatagaacaacagcaatttcacaatatctagacaatgaatgaatattaaaaatctatttcattaaaaagctctttcagatactggtatctgaaagaaaccatgttggacgcaaaatatatcaagaaatcaagaactcaatataatgaaaataaggctgaagactgcaacagatttgaatacagcatgcctctatattctagttattaatgattgatttttaagaaaacctgtttcagtgaaaagggcaagtaatcttttttaatctcactttaaaatatttcctagaactttctcattcattagctcacttgattctcaaaacaatgattctcattcattagctcacttgattctcatattctcataatcctaaaataaatgttattataatctgtattttaaagtttaatattttgaaagaaataaattacataatttgatgagggtgataaattgggactccagtcccaatttagttcaccctgagcaggtccattctcacatcaacctgttacaccatttaaagaaataaaaaatgtccattacatatatttttaagttacattcagtcaaacaagcagttaccttagcactcagatgtgtaaaaaccagtgcaacaaaatttcagtttttaacaagtcatctgaaacaacagaggacataattttgtcctgttcccaagatactttgtgtttatgttcctaaatcctaaattcctaaaattgcatcctgataaagaacagtaaatttgtttctctactatatttaccatattgcctcattacttgatccctccttccttccctccctctccccttctcttccattccttcttttcttccttccttcttttaataaatgtatatatatatgtgtgtatatatatataaccaataattaccaagcacttacagtacactgggcagagtgctaggctcttcactgaaaacacttcaaagtataataagagaaacaggaagcaatgaaatgagtcagctagttttggaatcaggttagtcacagttgatctcagctgcaggcccggaaggttgggggtgggctgccttgtattgcaaacacatgcatcacatcacacagacatcctgcacgctggagcacagtagcctgtcagttcccactgctgagtcatttacagcttttatcgtagttaatgccaatgattatatatgttaaaagtacttattaatccttgtaccaaatatagaagagggctcagacgcttcttatctcatggttcttaaatctaaccatgcgccatactcactggtagttttacaaggaatggattcttgagctcctctaaagaaatcagtagctccaagagagatgtttttaaaaatctgtttctagtaaactctcccagtgattgctgagtaacctacttaaaatgacattggaaaaccatacactagaaccctgcttttgatttttgttacaagatctagaatcaagttcaaatagtctagatagtaaaatattgtgagaatttttttttagttttagaaatcctacaagaagtataaaactattgttatagtccatgcaaccaaaattcttacccaactactggaaaatgaaggagtaaaaagagttggccagggtagagacatctggatccctcttcggcaacctaagaagataagtctgtcagagaatagtgattataatgagttaatgactatatgcctggtttgctttagacagccccatgtcatgccttctgtcttagtataattattaatcatgctacccatttctttctccgaagtgtccctatttgaacaacaagttatttggtcaccccaactaaaagggaatcttgtcagagaccaatgagtgtcgtttagtgaatatagaaataataagcaggctctatttattcatttattcaactcaattcagcaacacatttgtgctagcattcgcacatgccaagtcctgcataagtgaggaaagccccttgccttgtggagcttacagtccagcagtggaagactcacacagtatacaaatgaaaaacaaattaaaaaggatagagattacaataactgctattatgggaataaagaggatgatataataggatttcatgggatggacaggtgtaatgaggggaggccttctggcagaccatcatctgtttcaacctcattttgcataccttcttgtactccagaaactggaaagctaaaagctatgtttcatatcctcctccgcagctagggatctggatttagacacagacaaccagatatactcatgcgaagcactgattcagaactaaactgtagaaggacgacgcagtggcagagaaggtgtctacttcactggcacagaagtccagtctccttattgtcagacagcacataagatgtgttcctgaaggtaatggttctgaccccacttcctgatcccctactcatggttatagtagtacaaccctgaagccagcagttgggacagcagtcttctaactccccagcttcctgatgaggcagatgtagagggccagttctgtggtggtgttcttggagtctggaatagttccacatcaagagctattcccaagaccttctaaaaaattgtaagcactaacttaccatgttaagttcccttctgattaaaatggagtggtttctgttatctgtcacagaatgctaagtgataaagacctaaagaatgaaaaggagtcatgtggcaaataaggggaagagaattccagaccgagaaaatagcaagcgtacagggtcaaggctgggaaaagacttggcacgttcaagccacaagaataaagtcactgttgctggaggaatgaagaggtgggaatgcggaaaatgagacactgtgggagtctgattagggccatgtcagtgagagacaagttcagatttttcctagtatattgggaattcattgaggagtttcaatcaggcatgatctagttttaagaatattagactagatgccttgcagaaaaggaattaaagcaggaagattagtataggactatgtcagtagtactagcaggggtgaggaaaaggaggaattaaattcttggctttcagctagatcagaaggtagatgtgctgtaattcattaaaacagagacgaataggatagaataaacatatgtttgaagcatcaagagtttgttttcgttttgtttttgggtatctttggttgcacaagtcaaagttgagatgcaaaccagacaaaagactttgacaaggagagttttataaataagaatctgcaaaggaacagtcagttttccatggaaatcctcatctaaaccaggtcctagggtcaagacgttttaacataagagtcagaaacaaaacctcagagcacagtgcatccaagcacctttttcgttttttatacgaggtctcgtctttatcactcaggctgaagtgcagtggtatgatcacagctcactgcagcctcaaactcctggccttgagcgaccctcttgcctcaatctttcaagtgtctaggactacaggtgtgctctgccatacctggctaatttttaaaatttttttcttgagacagagtcttgctatgttgcccagtctggtctcaaactcttgggctcaagcaatcctccagccttggccccccagcgtgctgagattataggcttaagccaccacacctggccaccaaagcacctctttcttatgttggctgttaccaaagcctatcagacattccctctattaaccctacaaccacagaccctgtccttacctgcaaattcacgaacacttcctcaggcccaggaagaactggacgacttctgtctacctatactaccagcaaatgattaagtcagactgtcaggacgtctacaaccctcttattatatgtttcctatattctttcaactctgatcagttgttgggggaagtcagggaccccgaatggagggactggttgaagccatggcagaagaatgtgaattgtgaagatttcatggacatttattagttccccaaattaatacttttataatttcttatgcctgtctttactgcaatctctaaacataaattgtgaagatttcatggacacttatcacttccccaatcaatatccttgtgatttcctatgcctgtctttactttaatctcttaatcccatcattttcataaattgaggaggatgtatgtcacctcagtaccctgtgatgattgtgttaactgcacaaattgtagagcatgtgtgtttgaacaatatgaaatctgggcacctcgataaaagaacaggataacagcaatgttcagggaataaaagagataaccttaaactctgaccaccagtgagccgggcggaacagagccctatttctcttctttcaaaagcaaatgggagaaatatcactgaattctttttctcagcaaggaacatccctgagaaagagaatgcgcccctgaggataggtctctgaaatggacccttgggtctggctgtcttctatggtcgagctgtagggatgaaataagccccagtctcccatagcactcccaggcttattaggaagaggaaattcccgcccaataaatttttaacagactggttgctctcaaaccctgtctcctgataagatgttatcaatgacaatggtgcccgaaacttcattagcaattttaatttcaccccgtcctgtcctgtggtcctgtgatctcgccctgcctccatttgccttgtgatagtctattaccttgtgaagtacgtgatctctgtgacccacaccctatttgtacgctccctccccttttgaaaatccctaataaaaacttgctggttttgcagcttgaggggcatcacggaacctactgacatgtgatgtctcccctggacgcccagctttaaaatttctctcttttgtactctgtccctttatttctcaatccggccgatgcttagggaaaatagaaaagaacctacatgactatcgggggcaggttccccaataatcagtagccctgagactataagttgaagtctgcttactttgctataattactatctggaaagctgacttgctattcttataaatataatcctagcattgcaggataccatgggccatcttgccaatctccttgctgcacaaacttgctaagcccattacatatgcaagttttatcattataatcataatcatcaataccattgtggctgaggttgatgttatgattgccatacattgaaaagtagctatgtaagtcactaaacaaacattttatctccacttaaatatatttgtttgtctgaaataattacagagagaatatacatagatctatgtgtggacaagcctatctgtgtacgtgtgtgtacatatatttgtgcacaggcctaaacaaatatatatgtatggacgtatatgaaactaatatgtaatcagttaaaaagttaggttaatatacataggttaacatgtatgtatattaaactaacaggttatcatgaatgtgttatttgaactcatagtcattaagagatgtaaaactgttaagatttttcactgttggaaaacattggagagcctcaaaatatttaaacatctaatctttaagttgaaatgattcacactaaaagaaaataaaaatatctgagcatatttattcaggagcagcagtaaattaagaaaccaagagtttttttaatgagttttcactatattaatttcaagctatttattatgttatgggctgtctggtttgttaaagcctaattaatgtaagtaaagaagacccaagtaatcattaaatatatcactatgaaatgaattttagataaaagtaccattactttaagagaggaaagaacacataattgccatggttgatattaattttaatgtcatggaaaatttatttagtaggaagatgcttgcaagtaacatctgaatttttctctttgtttcaatatccatgtaaacctgagagaaattgcctagtagattttaaaaatctatagtataggtgttttaatcaggggtctccagagaaacagaaccaataagccaattccttataataaatacaatttgatataaagaatggctcacattattatggtgactgacaaatcccaaggtctacagggtgagttggccagctggagacccaggagtgctaatggtctagttcctgtccaaaggtcagtaagtttgagtctcaggaagagcttatttttcagttcaaatcagaaggcagagaaaagccaatgtcccagtttgaagtcagtaaggtggggggaaatctttccttggagaaggtcagccattttgtcttattcaggctgtcaaccgtatgaatgaggcccataacattaggaagagtagtctgccttactcagtctaccaatttaaaggtaaatctcaacctaaaacaccctcatagaaatgctgagaatgatgtttaacctgggcactttgtggtccagtcaagttaacacataaaatgatcaccacattaggtcaactctcagaatgcagaatgttttgcctttactaataattcatgctaaaggaaaaagtgaacatgagtagttacagccacagataatataagatactgtaagtctggtttcaaaaagcattatgtgaattcttcacatgttattttcaatggtcctccttattcaatagttttaatatatacctggtatctgccatgtctaccacaaaggtagacaaaatgctcactggggtcctagtcctttttacctcatgcctacctggccaccttatagctgctctctcttcaagacaatctactttctacatatttactacataaatattcctggctgggtatcgcagctcatgcctgtaatcctagcaatttgagagggaaaggtgggcagatcgcttgagtccaggaattcaagactagcctgggcaacatggcaaaaccctatctctatttttttttaaatgtctaatgaaaaaagaaatcctaaaacactgttattattacaatgctcccctggctcaggaacctaccatggctcaccagagaaacaaaggtagattaactttcacctccacaaaaagactatagctattattgtgtacaagtatttttttttaaataaggctaaagtttctacactgactttcagaatttcagagaggagtccaagttgtaagccagctggaaacaagatgactactataatggcatgagagtgttcattaagcaaattgtatcttgccttaaggtatgtatgtggggaagggggtgtatagtattagacaatgcttcatttaactagactttcttttcttcatcagatttgtttacttctcctatactctaggtctacgctaggctctagagtttcaacgcattaaaggtacagccccctgatggaactaaatagagaacccagaaataaacccattcatatatggtcaactgatactcaacaataaggaaagaaagtctcttttataaattacatttgaaacactatctacatgagaaagacatttgccctttatcttacaccatacacaaaaatcaactcaaaatggattgaagatctaaatgtaagacttgaaaccattaaaagcctaggaaaaaaacatggagaaaatctccttgacattggtcttgacaatggttttttggctagaacaccaagagcacaggcaagaagagcaaacaataccaagtgggactgtatcaaactaaaaagcttctacacagcaaaggaaagagtcaacaaaatgaaaaggcaacatgtaatgagagaaaacatctgcaaaccacatatctaatattcaaattatatgagaaattcatacaactaaatagtaagaaaatgaagaatccaattaaaaaatggacaaaagacctgaataggcatttccaaaagaagatatacagatgttcaataggtatatgaaaaaatgttcaacatcactaatcctcagagaaatacaaattaaaatcataatgaggtatcactacacaccttttagaatatctattatcaaaaatgaaagataaatgctgtcagaaatgtggaaaaatgaaacttttgtacatagttcgtgggaatgtaaattagtgtaaccattacagaaaacagtagggaggtttctcaaaaaattaaaaatagaactaccatatgatccaacaaatcactactaggtgtatttccaaaggaatgaaatcagtttattaaatagatatctgcactgtcatgttcattgcagcattattcacaatagtgaagatatggaatcagcctaagtgtctgtcaatggatgaaatggatgaagaaaatgtgatatgtatatatctatatatatgattctatatatataaaatatcatatatagattatatatcacatagagagagctccatatatatatatggaggctgaatagtacatacagtagagtactattctaaggaaattctgtcatttgcaataacatggatgaacatggaggacattaagtgaaataaggcaggcacaaaaaaaatacctcataaactcagttatatgtggaatctacaagagttgaactcatggaggtagagagtacaatggtggttacaccaggggctggaatacttgggaaacgaaggatgtggggagcagttggggagatgttggtgaggggattcaaaattttagacaggaagattaaattttaagatgtttattgtaaaacatggtgatatagttaataaaatgtattctacccttgaaaactccataaaaagtagaatttgtgttctcactgcaaaatatgtgaagtaatgcatatgttaattagctcaatttaaccattccatgatgtatgtgtattacaaacaatatgttatacaaaataaatatataaaattttttgtcaaataaaaagttttgaaaaaacaaggaaaggctctgaatagacgtatttccaaagaaaatagacaaatgtctaacaggtacatgaaaagatgctcaacattaataatcattagagaaatgcaaattaaaactgcaatgaaatatcacctcacacctattaagatagctgctatgaaaaagacaagaagctaggtgagtagctcatgcctgtaatcccagctatgcagaaggctgaagtgggaggattgtgtcagcccaggagtttcagaccagcctaggcaatatagcaagatctcatctctgtttaagaaaaaagaaaaagaagaaaaagaagaggaggaggaggaggaggaagaagaggaagaagaggacgaaaaagaggaagaggaagaagaagaaggaggagggaggaggaggagaaataatagaagacataagtgttgcaaagggtgtggagaaaatgaatccttgtacactgttggtgggaatgtactagaacagctattactgaaaacagtacagaggttcctttaaaaatttaaaacagagctaccatatgaaccagcaatcccactttgggtatatatctaaaaaataaaataaatattttggggagatatctattcctccttttccattgtagcattatttacaatagggaagctatgaaaacaacctaagtgtccatggacagaagaataagtaaagaaattgaggtacatatatacaatggaatattattcaaacattaaaaaaagaaaactcgtcacttgcaacaacgcggatgaactcaggggacataatgctatgtaaaataagtcaggcacagaaagacaaataccattatgttctcacttacacaggcataccttgtaaacattgcaggtccagttccaaatcaccacaatacactgaatatcacaatacagtgagtcacacaaatattctggtttcccacataaaagttagttttatactctataatagtctactaagtgtatagcagcattatgtctaagaaagtgcataatttattttaaaaatattttattgcttaaaatgctaattatcatctgaggcttcagcaaatcataatcttttggctagtggagggtcttgcctcaatgttgatggctgctgactgatcagagtggcggttgctgaaggttggaattgtgtggcaatttcataaacgagacaacaataaagtacggcattgattgacatatccttttatgaaagatttctctgtaacatgttatgctgtttaatagcattttgcccagaatagaacttctttcaaaattggagtcaatcctttcaagccctgctgctgccttattaactaagtttatataatattctaaatcctttgttgtcatttcaataatgttcacagcaccttcaacagaagtagattctatctcaagaaaccactttctttgatcatccataagaaggtactcttcctccattcaaatttgattatggaattacagcaattcagtcacatcctcaggctctactttctaattctagatctcttgctatttttaccacatttacagttacttcctccactgaagtcttgaaccctttaaattcatccatgagggttggaatcaatttctgccaaacttctgttaatgtttatattttgggctccttccattaatcgtgaatgttcttaatggcatctagaatggtgaatttttttcagaaggtgttcaatttcctttgcctggatccataagaagaatcacaatctatggcagctatagccttataaaatacatttcttggctgggtacatggctcatgcctgtaatcccagtattttgggaggccaaggcaggtggatcacttgaggccaggagtttgagacaggcctggccaacacagtgaaaccctgtctctactaaaaatagaaaaaaattacctgggcatggtggtgcatacctgcaatcccagctactcaggaggctgaggcatgagaatcgcttgaacccaggaggtggaggttgtggtgagcccagattgtgccactgcactccagcctggatatcacagtgagactgtctcaaaaacataaagtaaaataaaatatatttcttaaatagtaagacttgaaagtcaaaatactgcttgatccatgggctgaagaacagatgttatgttagcagtcaagaaaacaacattaaagtccttgtatatcttcatcagatcttttgggtgaccaggtatattttcaatgagcattaatgttttgaaaactatcttcttttctgagcagtaggtctcaacactgggctgaaaatattcagtaaatcatgctataaacaaatatgatatcaactaggcattgtttgcactgacagactagatttagcataattcttaagagccctagggttttcagaatagtcaatgagcattggcttcaatttaaagtcactagctgcattagcccctaacaagagagtcagactgtcttttgaagctttgaggccaggcattgacttctttctggctatgaatttctagatgacatcctcttccaagagaaggctgattgacctacactgaaaatctgttatttagcatggccaccttcatcaatgatcttagttagatctttgggataacttgctgaagcttctatatcagcatttgctgctcaccttgcacttttatgttatggagatggccttttttcttaaacctcatgaaccaacctctgcagcttcctctccactatcagccttcatagaattgaagagagcagggcttcgctctggattaggctttggtataaaggaatgttgtgactggtttgatcttctatacagatgaatcaaaactttataagcaataagactgtttcactttctcatcatttgtgtgttcactggagtagcacttttaattttctttaagaacttttcctttgctttcacaagttggctagctggcacaagaggcttagctttcgccctgtctcagctttcaacatggcttccttactaagcttttgacttaaagtgattcttcctttcaattgaacacttagaagtcattgtagggttattaattaaccttatttcaatattgtgatggcttacagaatacggaggcccaaagagagaaagagagatgggagaatagcaggttggtggagaagtcagaacacacacaaaatttattaagtttcccatcttatatagatgaggtttataatgctccaaaacaattataataataatatcaaagatcactgatcacaggtcaccataagagatgtaataataaaaacttttgaaatattgtgagaattaccaaaatgttaaacagagatacaaagtaaacacatgatgttggaaaaacagcacccaccgacttgaaatagagttctcacaaaaatgcaatttgtaagaaacacagtacctgtgaggcgcaataaaacatggtacaccaaaagcaactgcaacaaaagccaaaactgacaaatgggatctaattaaactaaagagcttctgctcagcaaaggaaactatcatcagagtgaacaggcaacctacagaatgggagaaaaattttgcaatctatccatctgacaaaggtctaatatccagaatctacaaggaatttaaacaaatttacaagaaaaaaaccccatcaaaaagtgggcaaaggatatgaatagacacttctcaaaagaagacatttatgcggctaagaaacatgtgggaaaaaaaagctcatcatcacttgttgatagagaaatgcaaatcaaaaccacaacgagacaccatctcacgccagttagaatggtgatcattaaaaagtcaggaaaacagacgctggtgaggatgtggaaaaataggaacacttttacactgttttggtgggagtgtaaattaattcaactattgtggaaggcagtgtggtggttcctcaaggatctagaaccagaaataccatttgacccagtaatcccattactgagtatatacccaaaggattataaatcattctgctataaagacacatgcacgtgaatgtttattacagtactattcacaataacaaagacttggaaccaaatcaaatgcccatcaatgatagactacataaagaaaatgtggcacgtacacaccatggaatactatgcagtcataaaaaagaatgagttcatatcctctgcagggacagggatgaagctgggtaccatcattctcagcaaactaacacaagaacagaaaaccaaataccacatgttctcactcataagtgggagttgagcagtgagaacacatggacacagggaggggaacattacacaccaggcctgttggcaggtagggaacaaggggagggagagcattaggacaaacacctaatgcatgcagggtttaaaacctagctgattgggttgatgggtgcagcaaaccaccatggcacatgtatacttatgtaacaaacatgcacattctgcacatgtatccaagaacttaaagtaaaaaaaaaaaaaaaaaaggtatgcctgtatgtgaaatctaaaaatgctgagctcatagaagcagataatacagtggcattcttcaaaggctagtgggtggggaaaatgagtaggtgttagtcaaaggatataaactttcagttataatgaatatgtttgatgatctagggtacagcatgggtggggatggatgtgttagtttaattgtggtaaccactacacactgtatatgtatatctaatcatcacattgtacacattgtacaccttgaatatattcaatctttcttaattaaacatttttaaattaaataaataaatgcatagcctctttcatgaagctcagaaacaagcagaaggtaattcaataatgatagtattggctgggcacggtggctcacacctgtaatcccagcactttgggaggtcgaggcgggcggatcacttgaggtaaggagtccaagtacagcctggccaacattgtgaaacctcatctttactaaaaaaaaaaatacaaaaattagctgggtgtggtgatgtatgcctgtagttccagctacttgggaggctgaggcagggggattgcttgaagccaggaggcagaggttgtggtgagcctagatcgtgccactctactcccgtctgggtgacagagcaagactccatctcaaataataataataataataataataataataataataataataataaatagtatctacctacaaagtgcttactttgtgccagatgttgtgcttggcactttacacatttaagtcatttaatttccacaatagtcctatcaaggaggttctcttattatctccattttacacatggaaaaaacctaagttacagaaaagctgaataatttgcttaatgtcattcactaagtggtgtaaccagaatttgaaccagacagtctggcttcaaatcctgtgcttttaaccatgagattctactgtaaaatttatcaaagaaaggtttcctagaagtgtaatgggagcccagatgaaatgcaatataggcagtggcttcacggaaaagatcatcccctttttcatatatacagttgacactcaaacaatgcagaaatctgcatataacttttggctccccaaaaagttaactacttatagcctgctgttgaccagaagccttactggtaacatatacaatcgattaacacatattttatatgatatatatgtgtatatatatatataaacacactctattcttacaataaagtaagctagagaaaaaatggtattaagaaaatcataaggaagagaaaattcattcatagaactgtattgtatttatcgatatcataagtgtatgtcatctgttgtcaaggtgaaacttctatctgaaatggtaggcaaccacggctgcagatctcaatctatggtacatatcaagcaagccaactttttcctgtaatgtcgtgacttttctctgtttcttgggagcacttcaagcattactactggcactttgtatgggtcccatggtgctttcaaggtttacagtattgcactaaatgcaatgaaaaatgcaagaacgttgacacatcactttttattgctatacacaatttactggagagatgaaattgctcatgtggagatgattagcatcacaaggcattttaagcagatactcacaacacttgagctcaccacaatagcagcagcaggtggttacaaaattattacagtagtacatatgtattactgttcatttcatgcagttatgatttaatgctgcacccttaagtttgtttacatttctctcaactgtaaacggcaccatgtatggtctgaaagtgtgtaagttttgatgaactttaacttttataatagattcatgtatattttatggcagtaaataataaaataggctagaatctacattttttacatttgtggtatacctacctttctgattttttgctacttctaagctacataatttatctgtgaattatctcaaattgtcacaaatctccaaaaaaatttccaatacatttattgaaaaaaattcgtggataaatggatccatgcagctcaaatccatgttgtttaaggatctactgtatttgtttgcacccatctctatctctccaacaccaatattcaaatatagctaggccatgtttctatagctaaaattttgcttttgtaggctgaggtaaccttactcctatcttttcaaataccctttctatcactgccaatggcttttctgtcccatttcctttatggataattccaaccaaaactgattttattttttctgaccaccatgataggttattaactgagcatgtattttcacagttgcttataattgaactctgttctctaattttttttcacatgcataagtcctttcacctaaaatagattttatatcacctaggcataaatatatttgcatcctctagagcagacagacatatagtaagtgcttaataatactcagtttgacacaatttaattgaattaagaagcatttaaatttaggcaggaaaactgaataaacattgaataaacacttttttttctctctctaaaatgctcatctggcttctttttcaaaacagtttttttttttccttacatatagtcagggtcttagactcctgaattgtagtctaattggcctaatttgagactcatgttggcagcaacaatttctgtaactatctggagttgtgaagcagttagccagagaagtatatttgacagctaagttatttctctacagaaaaaaaaaaaagtgttgaaattcagaaagggatcagttaggcttgtaatagttactgtttttctataacaccctttgctccccgtggcatctgcctatgtcattctccttgggtgctgagggtgggtgctgctagaacgtatgacttcatgatgcatcactcaggattccttccctaaattcccctatgaaatgttggttttcacctccatcatcctgatgcatgctctcttttgtccaaaacttctactctgttgtgtattctatgtgtgcctgtgcccagaaacttcaagagccaaggactttcattctccctgaggatgtttctaaggatctctctactctcatgtatgattttttacaatgtttgtaggtagaaaataaattatcggtgaggagagagaaaatgaagaaatgggagtgattgagaggaaagcatgagggagaagaggaagaatcatgaacatgagtggaggggttattctctaagaggccagcatgctcttcttccaccagtagggaggaataataaacatgtcaagaggagcagaaaaaagataagagttccttaaaatcttttgaggtggagaaaaggaactacatgaaagatgatggtaaagagcctaaaacttttccctgaagaaatagggagtaagatcatttgcctgagagatgcagcagattatgaaaatgacttgggaccatctttgtgagatttgggcatctattagagggtcatgattgtggtgagcacctgaatgaaagtggctggcacaaatgtattatggtatagtcactgaaatctatggccctcaggcaactctggatagggaagagagagaaagtatggacaatggagctgatccctgaggcaaataattctagaagggtggagatggaaagcactggtgtgactgacaggaaggtcgaggcttgtggggtggagggtgaaataagagttgtggagatttcatgtagcatgcatgtgagccatccagggacacgagtgctgggagtaagcgggctcaccagacacagccatccttcaccctccttcacaccaggagggcagctcaaacatgtttgggacatacaactatggactttgggacatacaactatggacaaagcttccccaaaaagagacaattaggaaaagtaatacaggccaataaccatgctttctctacatactatttcaaataagtagactttgtagtgtaacctgcatttctacttcaaataattgtggaatctaacattttaaaatacattccctttatattacatattaccaatttacatacttgtaaaaacataaaaatttaggaggcaataatttatttactcaaaattataacaggacttaaattaccaattattttggttaatatcggaataattttatggacaaaaaatcatttacttagaaaccgtgctaagaacataaatttaacatcatctaaactctttgcttatttctaggagtaactctttcataagtacatagttagataggttccttagtttgaatggtgatgtctttaataacttcggtgttggccgggcgtggtggctcacacctgtaatctcagcactttgggaggccaaggccggcggatcacaaggtcaggagatcgagaccaccctggccaacacggtgaaaccccgtctctactaaaaaaaaaatacaaaaaattagcagggcgtggtggcaggcgcctgtagccccagctactcgggaggctgaggcaggagaatggcgtgaatccaggagtgggagcttgcagtgagccgagatcacgccactgcactcagtgtgacagagtgagactctgtctcaaaaataataataataataataacttcagtgtttttttctctatttactcagttttccagagggaaggctaagcttgttccatattaggaggttaaaaaaatgcgtacttcagtgaccaagagtgtttatacctgactattttaggctcaagctctagggtgggggtatagttgattcacagattttttggattttgattctgaaatttcatatcctggggtgagttatttgcaagaatttgtagtgatgagcttttgtctccctgtgctagtgagttgttttgctgctgtgtggtggaggccaggacttttcagggtgatgcctccactagctactttgcagggcatcatagccaactgagagtcaaaggtagatgtaaccacatgtgaacttcagactttccatttgacttgcatctccagccctctagaattattcactgcagggatcagctccattgttcatgctttctatctcttccatgtccagaacggcctgagtgccacgaggttccagttactgcactattatatgttcgtgtcagccactttcacttgggctctcaccatgattatgaactccttagagatactcaaatacatttctcatgagggtagctccaaatcattttcataatctgccatactttccagctaaataaccttactatctacttctttaaggaaaaatattagggtctgtaccattatctttcatatagttacttttatatactttggaaataatttaatgtaaaatcaatactgcatattgtgggacaatggaattacctgggttttggagtcaaacacatgtgagttcaattcttagattagctactgaaaaggtgggagggtttagaaaaattattaaagctctgtgaactccagatctttttttacctaagtgtgtattataataatagacactttgcaaagttatcataaaatataaattaataaatgagataatattgatgggataaaagtattttgcataatttttggcacacaataaattatcacagtatgcattaatcgttttaacttactgagtgatataaaaggatattttgaaagtagttgttattaacacaaacatagatttcactttctaaactacattaagtggtcaaaataaaatgtttactcaataaagtattcatcagcatgtttttaaacctataggaattctgctgcaatcatattccagtaactgggtaggtctggttcaggtattgtactaaaaggagtcatgaactaggttgtaaatgattttgtcaaggtgtcagtcatgtcatacatgaaagtatgctgttgtaagtctgtgagagtcaacatgtgtgaaaaataacaatgaagggccaaggaaccaccacgacaccttacagaggtgtattattggacagccctgtgatagctgtgatagctgaagtttgcccaggctgtgatccactagtttttagcagggtaatctttctgtgcaaaaatgccacacaattcaccaggcctccagggagctgggaaatcacaaatagacagagacttgaagagtgggtggatttttttttttttctttaaagcagcagctgttagtttaaaagatagtctttagtcttgaaaaaaaaaaaaaagaaatacaaggtatttactgatttctatagcaagttctatattttttcttttcccttacttcttctaattccaatgttatgttttttaaagtaatagtgataattttatcagtgtctctaatttataatgtctctagtaagagtagctgttatatcaatatactataaacataccctttcttacttgtcactccctcctctccttctgcttcttaccttcctttcttgtctctctcttcctgttcttcctttattatgtatatttaactcatgttattctcacaattttttttttttttttgagatgggatctggctctgtcacccagaccggagtacagtggcataatcattgcagcctcaacttcctgggctcaagtaatcctccttcttcggccttctgagtagctgggactacaggcatgtgccaccaaacctggataattttttaaatttttttttgtagagacagggtctatgtggcccaggctgttctcaaagtcccaggctcaagcgatcctcctgcctcagctgggattacaggtgtgagcaactgtgcctgaccacaagttgcctcttaaatgaataagtggttattagagcagtcatcattcttctgacagaaaaccttcctgacaagggtttcatatgtgaatataatgaaagcaaaatttaacttttaaccaaaaatgttgcagtatattcatttgaaaaggatgacacagaaaggataagtagattatttctgagaccccatacacactgtctttacaattccaagattcataattctaatatactaataaaatataaaacttttagtgtttataaatagacaaaaatacatgtggatctcttataccaactgaattttatatattaatacttcctcgaccaaaggtatttctttgtaatttttgtcttacttttacaaaacaggaaaatgagaaaaaagtaaactttcactagacagaggtagaattttcattggcatctctaagaagagtatggggagactcagagctttcagatggcttttgaggaaactgctttgtgtttattttgctgccttccttcactttttccctctagcaaacacagagattaaagatcagtgtgttggccattctactgtcatcacaacataaaatgttttctgctctcttgagctgacatctcatcagcactaacagcttgaccctacaccccaatggtatataggatatacctgtctttaaaatgtgtgaacagaatgttatctgcagtgatttttctttttatcctttgatctgtcactatttcttcacaatgtcaaaagcctcagggcttggcttgaatggtgatcaaacccaaaggcacacaattttgggtctaatcctgaatctacacaatcaaaaatcttttcaattcagacccaaacaccatactttgtcttacaatactgaagtgcagccatcactaaagcactgctttcccctttgagctttttaaagaatgaatataatgaggttataaagaaatgaaacatttcttttaccaactgtactataataatacatgcatctaaagaaatgcatgcttccatgacctttcagaagattaaactctttcttggtgttgttgccattgcccacaacacttattgtgaaatttctttgaaatctacttcaaagatattttcccaggttcatcaaaaaaatcaaagtgatcaatttattttcacagaacattcaatttacctaatactttcttcctttcattctttctttacctccttctacttagacttgacctctcctgcactcctctgattgttgattcgctttcatttaacaaatgttaattgaaaatcaagctctgtctgtgaagatgacttccctctacctgtattaaactgtactgtcgaaaacttcctctaagtctctctaccccattctccaactttgcaaggaacaacactcctgatggtgcctcttttaataggcctaatcctcacctcattttgtagaccctctagctgttctgatttttttgttgttgtttgcttttttgaagattaggctaggacaagacctcctaatcccaggatttgaaagacaaagttgtaccaatgaacacttaagcagagggacatcaggaggtgactaatttatatgcatgtttctaataaaattatgaactatgactgggtatcatgaataactagaagatactgttccatcaaatctgcacggacactctattctttaactttcctcctgggcgtcataaaaatttttaatcttatttccaactggacctctccagaaccctgcatgaggaactcaacccaacatgtttaaaactaagtgtattttctctctacagagtgcccttcctcttatatttattttaattagcaacacttccatcacctaaaggaaagtgagttagcctagattctattttgttatccctttcatctagccaagtatcaccaagtgtcatacaatctatctcctacatacttcttgaatcagcctcaggttctgcatctagtaccacagctctcatcatcatccactagatgaatgtcatagccttttagatctttctgcctcaggatcatctctctccaatcagcccttcatgggactatgaagatgatctttctaaaaaacaaactatttatgtcactgtgtagcttaaaaagtctttcttgtttcctatagccttgaagataattttccaactctctgctactgcttatattttgagcagctaatgctacccttttctcactaaagaaaccaagcacaagcaagaatgcatccatgataacatgttctcccttctcatcttctgttttgagcagtcttcttacgtatcacaataataattgtgggtcatttctatcacagcactgtcacattataacttgttctcttgaatgaacttcataatctttaaggagaggggctatcacccaatatttggcacagtgcttgtgataggcagaatcatgcctaatcctgagagcctgtgaaaaaaaatatatataattatatatataatatgttatatataatatatatgttatagataatatataatatatgtaaatatataatttacatatattatatataatttatatatataatttacatatatataaattatatatataaatcaaatcagacaaggctgtgcatttgcaggttttctttggagggtgcttttccctttattaataaagaacagatcaccttatttcctcaggaagaggtagaaattgaagggctgtaataacgcccctttctctgcctcttcatctagatgaaagcagatctaactgcgggtggcattaaaaaacatgatgtgaagaggtataagaaatatcttcttcacaattatgcctccttcatgagacctcttacatttctttatttcacctatatttagaaattatgtcaattaagaatccccatttgctgttagctgttggcttcatttgagaagttactacagatgtagacctgcggccaacggaacaggcctgggtggaggaaatagaggcccgcaaactgatctggaataaagaatgaataagccaagaattaaagacccccatggatgctagaattcagaacatgacagaatcagaacaatggctcaagaatttgtaattattaatgctcagaggcgaaccaaaaaaaaaaaaagtttcactttaggcaacaggacacccactgccaaagatatcaagggaatcagtgttcttgttaacagcaatactttgggaagctttgcactcataggtgtgggcaaatgaaagtgtagttatactgaaaacaatgatctgtagagaactttgaaactccaagagaattttacaattagctacatctttgtgtgaatcatctaagcaaactctatgtctcctaacatctacttaagttcggccactctgggcagtgggtgaaaagtaagaatgttgaagaattttaggtcaaggtaaaaaacacaagtgatcagaaataacaagaaggaaaaaatcagaaactgttaattttagtaaaggcagcacctatgcatatgatgcactcctggcctccaggagtttacatttgttagtttcccttcaaaacctaacaacatttacatagagggcatacatttttaaacaggtgtctgtgtgaggtgattaagtgattatgtttttatgttttctctgcttggagatatcgtgattcacttgagtcctcctctcaaggcttagaggaaggaagccgactcagctactactgtgagttctcttcaatgagatatggaagattagctaattgttcaccaaactgtacctcttttcctcctgagcaggcagctgtatttcccagcatcccctgtagttaagcgcaggcctgagttctgccaataaaatgcaagaagtgttgcatgacaattccaaatctggctctgaaaggcttcctgctgagtctcccatgcttattatcttccctcaattgactagtgaggtgcaaatatacagcaggaaaactcgaggccctagaggatggccaagtcactgtgtgaaaggaaccttagttccctgaatgattgcctggaggaaaagtccctctcagcctcacttacctgcactggactgtgataattataaagcaatcagcctttttcatgtcaatccactgagagtctggcattgcttattacaactggttaacctaacaaatatgtatgggtatctcaggaatgcttcatagtgatccatttatcttctttatggttgtggaaagtgtgtaacttaagaacacttttatgtaaagcacattttaaaatatgtgcctgaaaagggacagctgaaaacatgtacatatgtataataaactatttgcaaaaaaaaaaaaaaattggggggctttgactgttttaatacatctcctgttatcttcaaaactgattttaagcagtactttaaaaagaagtgaaaaatcactggcttggggaagagaagaaaatgaaataaacaagacatccaaagttacttgaatggatgcacattcttatatatagctggaaacaaatagtactttgtgtcaggttttacagtctgtgggatctctcagatgaggttcatgctgtgaaaatgaattgcaaaggagatgacaagaacagatgtttgctcaagatgactgaagatgtttctgaaagcatcaaagtgtacagtctacaagttatcagcagacaggtagattgtagccaacttttagatttgtattttcagacaaaattggcttctctaagggtagttttattatacttggtaatgaaagaaagtgatctgtgtgtcacttttaacttagattgtgaataatcacgtacataaatacatgtgacgcatgtttatttcaacccaaggcatccctctttacaactgagcaaagaacatgcccttgtcaggccccagattgtgatgctcaagacctcacaaatagaagcaggaggccctatctgttctttccaagacttacactgcctaggacgaaggtccacaatccctatgttgactaatagtaaggctaaaagtggaaggaatacagaataatccaatctggtccactcctactctaaagccctgactgtaacagaatgtcttctggcttccaatagaaacaaggaatgacctagaagctaagaatataagcttatgaggccgacttaaccaattatcaggttggacatttaaatgtacctgtgttatataatggctgttcttgcactgcaataaataaatatctgggactgggtaatttaaaaagaaaaggggtttcattggctcacagttatgcaggttgtataagaagcacggcgttggcatctgctcagcttctagagagacctcaggaagcttacaattatggcagaaggcaaagcgggaacaagcatatcacacggccagactaggagtaaaggagattgggttggaggtgccacacacttttacacaaccagatatcctgtgaactcaagagcgagagctcacgtgttatcaaggggatggcctaagccattcatgagggatctgcccccaggatgaaaacaccacccaccaggccccatctctaacactagagattacatttcaacatcagatttgggtagggacaaatatccaagctacagtatttctctgtgtttcattttgaagaaaatgttaaatggaagtaataatattttctcacagcattttttgagaagtaatataattaatacatgttaaactcttttaagagtgtctgatgaatagtaaactccatgccatccactatatcatggttatcattcatggatcaggttaaaaaaaaaacgtagaggatagggaagtccccattctagtggcagtcacagaccccttgttctgtgattcttggagagcaggcaagcccctacttcagtggcttgcctgctagatggaccaggagacttggagtcaatagttctttgatacactaatccagacccttcacaagcatgtggatccagactcctaaggggtgatacacctctgtgcctgtgctgatgagcgggtccctgctctggccactgctttgggataaaaagcttctcccaggcaaggtggtcccaatcctccaagtggtcaacaatttctgtcacttactccccatcctggcccagaacagggctggggccctggtcctattgccattatcttccccaaaatcctccagaatctgatggcccttttctactagtgagacagagtccattataattcagaaaacaaaagaggaattggaaagtatctgcccctatctcccagaaaaatcttcagatttttataaaaattggtatatcttactgcagagctatacaaagtgaaacaagtgttttttaaaaatctgaaactgtaagcccagcaaaccttccaatctaaagaaaattctgacaaaaccaagataggccacccaagatttgctccaagaaaaaaaaaccatttctggtttgcatgagtaatgtgttattatttataaaaatattgtcaagcacttaatataaatttacatattcttgatatatcattttcctctttaataaaataaaattcacccaaagtatatcatagttctcaattagctatgttccaattactgcataactttttcataaattctatacatacttacgtgtatttaatcataaaaataaaataattttaactattatctaaatatatttaaaccaaatatttaagtaggtaaatgacataaatatagaatatttacatacaatattaatatatatcaatatataggttcaacaagactgcatttagaatattctatataattctgtgggttgggtatgacacatttgagtgcattaagaacatactttttaaaaaatgctgatcattgacattcatatattaatacatgaaatctgtatatatttagaaaaaatatttgattccaactttaattgcctcagaataatgtaagatttttaaatatagtatatgactacatgggaatttaattaaaaacctatgcttaatgaattggtacaatgaagatcttaacaactcaatgggatcagtttccatataggtagatgtcccagatacaaacttttctaacttccccctaaaataactataaacactaaggaaaacataaaaggaaatacctcatttaaagcaggtacttacagtaagcctaattccaggatctggaaagaatttcaaaatggcttaaagtggattttaaagcatacctggtggattgcccagaacagaaaacacttgctcatctgaaatcatacacacacacacacacacacacacacacacacacacccctaaaaaaacaaaactataggtcctcccctgctgtttgcctctccacactcaatatctatctcccacaacctttaagacataatagaattttaacaacctgaaaacttgagtagctgggcattacagccagctgggatgtgtatagcaagtagttttttactagtattattgtatgtacacatgagcacaattaatataagattacattattgatgcttacattctgatatgattgacatgctgaaaggggcggagctactaagccctatagacacaaaaggaagtgagtcatgcatgtgaacctcattttaagaaatgccaggaagaaaattgttgagaacttgtctactccacagccactgctttaaaggcagcatgagtaatctatctgccactatccgccacgcaccctccccactgccattagtgctctcttcacagatccagtaggggactgcagcacatgggtagcaaatcaaggaagggagaaacacgtgaactaaggccattctcacagtgctgtgccacacaaagctcctcctgtctgtgcccttgctgacagcgctgcttggaatgctatctgtgcagaaccactaatttccctttgcttcctgaagaaatatggaccccagctggctggctcacagcgggagtagaagaaaagatcccattgcagagcagtaatgatgcagaaaaggaaagcctcctagatactaggaactgggcttggagctttgtgttccaattgtcttctcaatctgtgaaagaccaaacaaaggagcagagaaagaatctcagaaaagcagcatacccacactggctctggagaggtgggccgtccacacaaatgcacaaataagaaaataaaaacatacagtaactttgaaaaacactcgaagacaaggaaaacttgattctgaaaagtcataggaagagaagacctttgaaaacacttcaatacaggagctagatgaacaactcagaaaactgatcagctcaacaggtgacaaggagggacaccatccatggtccaggggaggcttcctgctggcttctgggccctatgtgaggtgctcccagctgcctgcccttattccctgttctgcccaccctgttctccttgctgtaccttaaacatgtcagacactcttctagccagaaagttctttcctgagataatcgctagcctcaccacttcatttccttcaggtctctgttcacacaggaccttttcagaaaggctttttctctgaccacactgcttaagtagcagcttccttcactctttttctcctcaccctgccataaaggcttcacagcccttgagtgcaatggcaagctatcatagtgattaaagacctgattccgtcccctcccacctgtatgaagttcagctagctattcaccctccctttgcttcattttctcacgtggcaccaattgtagcccacatgattgctgccccaccctctcctcagtcaccattccagagtgctctgatggcttcacactgctagtacctgcaatctgtagccagaaaatgtcatctggccccaggagcatgttcaacctatgtgctaagcaggacagaagagccaaggagtcaaaactccagggaatggccttcacactatggtgagggggaagataactatctcagcttccttaccccttgggtggaaaaattaaggccatgtcgattccagaagtctgcagccaaactaagacccagttgcccatatcctatatgccgtgtaatatatttcttctcctttctctccctgtcttagttctccactcttttaccagtccagcactggggaagtagcaagcaggtaacttcactaagttccaaaacattaattgtgttttccagtttagaagttctgcatttggcagatactgggtaactgactagccctaaatgaagtgacttttgtatgtgattaccttgtgtcacctatgatttctttttcctcatctaagatctcagagagaggatctcgagctctgaaatcccactgaagccttaactcaaaattatttttgggtttgtaagaataagtaaatgtctctcaagtattgaggcaaaagtaaagaccttaactaaagaggaatggacatcagattgtcctaagctacctctactacattaactgctggatgacaatgtcacaaatctaaagagttctggagcaaaagtctgtgttccaagctaagataatagaaatatagtatcagatatgcaagagtttagaaagacgatcttttactgagaaagttcaattggaaaaacaaaacacatcgatcaaataagaggagaatcaaaagtaacaacttaggaataaagaagtaatgtaagagtaatgtttgagtgtcttctattcagatcagactatgatgtaagactcatggaactaggaagattagcaacagttccacacataaaccataaattgtgtcaaagaaatagtactagcaatgcactgatttagaagttgaaataatttgggatcataatgaaggctatgaagcttgatcaaagatttgaaagaaaagatgtgtatttgtatggataggaaaaaaaataaaataagagcacttttgaagttggaaaatgcctgagcaaagatccaagattagagatgctcaaggtcaatttttgccacagtgaatacaccagctggactggaaatacagaaatcactgtagcatatcaggatgtaaatttggaaaagtgaatttggggtagactgtggggggacctggatgtcagaccaggaaattaagaatattttattttgtaaacaatgtggaactgttgagaactttgtgaaaaatcaagtagctaaggggcactaacctgtatctgtggaagaatgaggcaggatagaagcctgtcacaaacatttgaaaagagagaagggaacgtgaaagatatagtgcgataaacaaaacagcaatagttggtaactgcttaaatatgaggctcaatatggagaaagttactactttgatatatcaaagttaagataatgttgaggaattaaattaaaaattagggaaacaggtagtttagatacacagcatagaaggaataatgttatttactatctacatttagggataatagttggcatttacttaatttagttatcaaattctcttttcgataaatctgtataacatctcttttctcgaatataattgtttggtaaacattacagcattttattaacaaaccttgttaaaagttataacaaattatacatgttttaagaattaatttggaatacaattatatgcttaaagggacctcaaagaatgaagactttagatgaatttttcatattaagccaaatttgtcaattggaaagaaatgtatataaaagattttttccatcatttgtcttctcctggtgtcccaatggtaaagctataatattgattaattagaaagagatctcatagagaagccattttattcactctgataccctggccactctcaggaggacgtgagagaaccactcaatatcctgagcacttcctgtgtaactgacttgcctctagacccaactttgaattaaatatttgccctggaacttgaatcatgccagaaatttgaagaatcaccttttgcgtttcctgatttctatttccacctattccctttcctatatttatctttaatttctaaattttctagaaggagaaattgaagtaatattggccgaatattcccaatggtagtaaacaaaagagaaacaaagtacctaccagaaactgaccatcttaacttgtgcattctgtgacattttattaccaaaatgaactatttctacgcatcccaaatctcctactgacttctacaattaatatattcccatattccacaataccaccaggaataagtcaatatttagattagaatatttctccagcacatgcacaattattacaatgatcatggtattatcaatacatatatgtattcatataatttctatcataaatatttttccagagacaatgagactatatcattttattatttcctcattttctatgatgtctaataaatatccataaataaaaaataaatctaagtaatcaattaagtatattatttgtattattaaggagtattttcccctttttaaatgagatgttcttaaagcaatactgtaaagaattctaacagataatatatattttctattttgagggtataacatcatttgatattggaagaattgccatggggtaaaaactggaatatggaaagctaccatattgacaatccctcagcatgcaagtatcaccaaaactcttacttaaatgtgctagtagttatttcttgtatacagtcattaaatttagtttgtagccagaacaaacattatcataatatattttttcaccatattaaatgtttaatataatttcaataaactaatttatactatacgactgaaaaactacaggcagattattaatgatgataaaagaccagttgtaaaagaacatctgttataaaagttaaaaggcccattaagaaattatgtaattaagtcttctatatccattcggagcaacagcaaatatctctaagtcatttaagaaaaatccaaagtccccaattaacacattctttttattcttttgaattttgcatcttgtgtgaattgtgccttaagagttattagtagaatctattcatatcccaaattagaggaagacatattagtgaggtcaacctctctagctgtaatcacttagcatatgaaagaagaaaacatatttttcctgtttcattaaaaatgtgaatatggcgtatagagagctttataaagcagatcaaaaaattcacttatccttatttgtgcagtccatttgagctagtaatttctgcttaggtgaaggtctgctcaactatgttacagcatatcacaaaacccacataaggaaaataccttcatttatcattgttaaattttttcaagtgtagaatactttccattgaatcactgtcctctgtaccaaaatttcaagatatggaaaatctgaattttcttaagaatagtttaggaataaaaaaatcctgtttagtttaaaggcatattcaagctaaatcagttatgtttaggtcacggttgcccaaccatggcctatgggctacatgcacgtgtcccaggacagcttggaatgcagcccaacacaaatctgtaaactttcttaaaacattaggaaaattgtctgcaattttttttttaagctcatcagctatcattagtgttagtgtgttttacatgtggcccatgacaattattcttcttccaatgtggcccagggaagccaaatgactgggcacccctgatttacatcatgttagtcatcacttttttttcttcttcactaactcacctataaagagcaatgtccttcctgataaagtgataaagtgaaaacaatgttagaactattaaaggacattttaacactaattgatccaacctaatggaaactgtaataaaagaaagattagcaaagcacaaatttttcttgcttttactttgtgaaagtatttgtttactttattatatataatatacattaaattgataatataataatgtattatgtcaggctatatgtttggaaatgaacagtgtctctttcttcctaattaaaaaaataagtggcttgcttggaaaaaaaagaggaaaaaaaaataaagccctgtaactaagtctcatttataaatattaatgcaaaaagttctcaataaaatactaaatattaagtaaaattaaatctaatattatattaaaaacaatatacagtatcaaagaagcatttattccacaaaaaacagtgtagttagacatttggaaaaaattgataaacgcattaataacggacaaaaatacatcatcatgttgataggtgacaaggcatttgacaaaatttatagtgtatctatatttagtaaaactttaaattagaaatcatttttaggatggtcaacagtgacatcagagatcagcaggcattatttaaaaattgcagtattagaggattagggtcaaaacaggaatgcccagcatcacaatcagtattccatgtcattccagatgtgctaaccaatgcaattagacatgtaaaagaaataagaataaaaataactgataatctgaaattccactggaagcagttagtaaataaaagtgctacttaaaaattattattttaagcatatcaataacttcttaatatacctacaattacctgaaataatgagaaaaatttaattagcagtcataacacattaataacatcagcaaatatcaaatctccataaacttagtgggaatttcccagaactacattaaaaattataatatactactgagagataatatgagttgaatacaaaatgtacacattgctcccctgtacagatatagtattttctcgaagttgatctgtaagtttatcctattcctaaaaaaattccagttaagtggataaattttaaaacatgtatttatatgttcaaaaacaaagccagcaaaattttgaaacccattctaatggcagtggcttgccctattagatattaacatatatcatggcaatattttaaataatgatatactagcacaaaaaaagatagccagattaataaaatagacaattcatagcagatctagaaaatataatattgtatagtaatatattcttaatatttcatattattacattttaataatatattaaaatggccttccacatcactaaaaaaatttgatgagttttttgagaaataactttggatactggctatcaaaaactcaaaaaattagatgtctatttcataacttacaacacaaaatgaagatgaattcaatgtttcattattaaaatgacatcatgaaaaagctacaagaaaatacgtatttttaaaagtcctgaaagcttactatggctattttagtttaaaacgaatttcccagttcaaagattgacctgtgaacaagatataatagtaaacatgaacttatcaggtaagagtaaaacaaaatattttattgacatctgcactctgggagcagtggtgagaaaagagaaaggtgtttagcaccaggaaagagagacatttggtagtcagtaatcaagggagggtttgcttatttatattactcttatttagtagagagttggtagtacaaaagaagagaaacctttttgaaagttaatatttttggccaatccaggcctttcacaggagatcttccataggactgttacacatttctaggcataacatgacagaaagtgcagaggagaatcttgatggatgggccctcacaatttgtttaaattgctgtagggcaagtaacaccaaatatgaatagatgaattacagaaatacaattgtaaaatatatgtcagacaacagattaatgtatgtattctcaaagagattttgacaatcaaaaggaaacagaggaatattccaaaagaaaaataggcaaagtaatgaacaggcaatttgcaaaagaataaatacaatggctaattagtatacaaaaactctaaatctcattaggaatcaatgatattcaaatttaaataataataaaattaagttcaccactgatgtatataaagatgaaaaataataacacccagttttggtgaatgtgtgggaagatagataaattgatctgttactattatgtatatgactatgaacagcaatttgagagtagctatcaagaatcttaaaggcagggattacatgcctaagaatttttccatgaaaataattgaacaagtaaattgttgtcatcttcttcatacacaaaggacgccatgttgttaccgagattaagataaattatttattttttcagaatgaaaagctatttactattgtaaagactctgtcctcgcagtagactaaaatcaagaaaacacaaagactcttttttagacggcacccacaattcaaaagctctaatcacaagaacaaagagagacacagaataaaagagacagatggagacaatgtgagtcccatttgagcacctgcagggaatgggttctctgaacagtaaaaagctggaagccgaagcagggacacctgggcattacccatctttctttccctggatgagaatgaagccttgctaatgctaacttcaattcaagaaccagaagagcccaatatttttatacaataccttaaatagaagtgcacagattgttaatgttaagttcttccagaaggctgatgtaagctctgggtacaaaagactcatggctcagcacaaatggggccttttcctacaccactctagttagtatgggcaacaccaacagcaattctgtgatctattccagaaccaggggccaggaaatcctccgacagaatgtgccatgctaaaccagaaatataacctaacttaacacatacacatgtacggtctcttctcactaattggaaatgtgcaacacctttacaactatgtacctatttaaattcttaagccatttttatttttaatttcttaagccatgtgcaaacataaccccctgaaagagggatcaaacctgctctagagtttataaacacaatctgctgaaacaagcaaaagcatttccatttgtcatgcttgatatactcagcccatcctgtaatttgaacaaggttattcattaattaccttggtaattaatgttatgtcaatgttatgacataatgggtgtcaatgttatgagtttataactgcaaactggatgtttttgtgtccctctccttacatttaggcaaaaaactgctttaaatatttctaacctttgctactgtatttcctctgaggctacacgatgccaagacagcttaatagaaatggaaaagtgcagtcagtactactgtaaatagctttttcatatgaaaccaaatatgcttatgtttgtaaatatccaaagagtcatctcattggaaaatctttaagtcaatgttgttggcatcacagtaatactgttgagtttctagagattcaaaatcatctctccacttactaccatttcaataaaatacagtctttctcattctccccctaatgataaccttgaaaccaccattgcaaaattataactgagacagtgaaagagatctgacctaacgaactccatcttgcttctaaccttcaagctgtcctgtccctttgggaggaactttgtttatagtttaaatcaaagatgataatagccctttctgaaaacaaacctccttcctgcctggggactagactgcctttgtaggactaacaaattagccacaagattagaaattatggtttaggaatcatgcagctggagactacaagattccgaccctccccaaattgctcctgagggtaacatcactattgtaaagcctaagaccagtgcttcagacattttccagaccctgtacttgatagatcagctggcaccacccaagatggataagctggttcatctgatcttgtgatctccaccaaggaactgactcagtgcaagaagacagcttcgactccttacgatttcatctctgacctgaccaatcagcacttccaacttactggcacccccacccaccaaattatccttaaaaactctgatccccgaatgctcagagagactgatttgggtggtaataaaactccagtctcccgcacagccagctctgcatgaattactctttaattactctttctctatcgtaattcccccgtcttgataaatcggctctgtctaggcagcgggcaaggtggttacaacctctctcatgatattaaatttaatactagactgaaaattcactagtatgtaatttttccattcccttcctgagcaatgtccagacgtacaaaaagccatttcaaatgaccattaagtttttcattcattcagcaaacatctattgaacacctcttagctatgcactaaactaagtcctgagaatgtaaggtcaagtaagtcatgactcccaccctcaaaaagctgtagtctagggtggaggcagacaagtaactttgcaattcaattgcagtatggtaagtgctacctactgataaaggagcatgtaggtggaacatcgaaatcagactaacactaacgagggtgatctcaagccagagaagcctttctagaggtgacttttgacctcagttttgaaagataaagagtaaaaggtgaaatggggttttgaaaaataaagagtaaaaggtgacatgtcaaaaacagaagagagaattattcaggaaaaggaacaacatatgtgctatcataaaggtgggcatgacccatttccagaatcacaaagtccagcatagccagagaaaagggcacatacagtacaaagacaataagaaccttttcaggacaggtatgatgtgttaagccaaggagttgaggcaggatgctgaaagctgcagggagctatttcatgactgtaagcaagaggaaagtatgatgatagaagtgttttgaaaacaagccctctggctgctgcacgtagcccactagagagaggggaataaaatgttactgaaataattaagataggagcaatctagtggggaagaacaggtttgcaagatatttcattaccggtgaaatactgaaagcaagtttagtagtttaaactggttcaagtttgctgacttggaagaccaggttggatgctgtttaactcactaagatgagaaactcaagagaagaaataggtgtgaagtgagagttaatacacctaattttgaacttgatgagttgaacatccaagtgaaggatacagttggagaagtgaaaggtctagatctttctagagagatgagaatcatctgtatagaagagaaggctgaagccataggagtggtcaagattaccagtgtggggggtgagtggggggttgggggatgcagaaagaagaacagaggaaccagcatagagccctgggaaattctacgttgaggaaagcatgagtggtagatagactacaaatatttaattgctagaagaggagaaggaaaagaaggaaaaaaaggaggagggggaggaagaggagtaggggaggaaagaaggagagatccacagatgttgatgaaaaactccaagaaggttaagtgtctcagatgctttaacaacataacttaggatgagcagcacaaatgtttggagccttcagcaacgtgcaaatcagatctgaaggaaatattggtacagggaggaagaaaaggagaaggaaccagattccagaaggctgaagagggaaatgggcagtgtggctgtagtgtagggcagttttccaaacagtttattaaagaagagaaagaagaatgcagacatcctcatatcaaccactacatttaaaaggactaattattattatccaattctttcacaaggcatatgttggcaacatccttttcaagcagaaataaggtctttttaaatcaattttaatggaagaaaagatatactccctttccccattctaatctgatgacaaaagttctaataaagtagcagtgagaacaggagcagtagctgggaattagagtgaatcaccttgagattccatccaaagttactcaaaattgtgtttgcacacacacacacacacacacacaccacatacaaaacatagtttatattagtaaagtataaataaatatgttatattcacctcttagcatcttacatctttgataagaccacggtgttacgtttagttacctaatatttaatagcagtgttttatatcacttctttccaagagatttaaatcactgttctcaattttcctaatgcaatcttctctcattattcctttttgagattggtggtgatcctcccacaacccctttgtataattattttcagttattactaatgcttgtttataactctgatttaacatcagctataaattacagtcatgcaccacacacatttcggtcaataacagactacatatacataatactgaatttttactgtaattttctatgtttagataggtttggatacacaaataccattgtgtatctaatactaatacaattgcctacagtgttcagtacagtaacatgctgtacaggtatatagcctaggagcaatatgtaccatatagcctaggtgtgtagcagactataccatctaggtttgtataaatacttctatgatgtttgcacagtgacaaaatcacctaagaacacatttctcagaacatgcccccaacgttaagtgacacatgactgtatcaataactataatggtctacatttatatagtattggtctgagagatcccaaaggacctttccaaacaatacatttttcacataaataaatgccaggcaacattgagaatgataaaagcaaccagtcacacaattaacatactgtttacctagctcctgaacaataaaaatgcttctcaagactcaagctgatatcaatcacaataggtactccactgaacaatatgccacaagctaatatcacctctgattattaatatggggcaattttttattccctaggagataacttgtatcaagtcaaattgaattggtttgtacaaacagtacgaagacagaaaataagaaccttttcaggacaggtatgaaaaggatcagtggcattttttaaagtcttgactaaaatggtactttatgcataatttatataaaatctttcttatactgagctttttctgctaaacagggaaatctgtgctgataactgaaacaaaaggtggtcccaagtcacaaattgagactcaagtaagcactccttccctgaccttgaacaaatcatttatattgtttacctcagtttcactgctttggaaagaaaactctatcatttctgacatgaactcagcaattcttgatttgaaaggtcatgaaaatgtgctgagagattcctctttccacaggtggttttggcagcagagtcttgtcttaaagattcacgttattcaggtatttttgttaacctgccataataagtagtaatgtagaatttcaagaaaataccgaagcatagacatttcccaacggagaaactctaacaacttcctgcagtaaaccacataagatattaacaatagaataacccaaaatacatcttcctatctaaaactgatattactatgaaaatgagaagttgaaagtgggggaacttaagaattagtgataaataaaatcaatatgggcaattaactatcctctatatagaaaacaattgcaagtataaaactaatacttgcttatatggctgtgaataaaaccagtgagacgtggctacagagagtaggctttcaccattacactcttctggtctgactccaccaaaaagcttttagaaaatagattactggcagtactcgggatccactgaatcagaattccgtaaatctgtgtgcgtacgtgtgtgtgtgtgtgtgttcagtgttcccgagttgattctaatgaggctgtttccaatacacagaagtcactaaccttgcttacctgcagaaaaccaccaccaccaaaaataaaacactgttttcaaacagaggaaaggaatcatattctccaagcatttggttttccactgggaggactgtcacacaatagcttttaattcagagatgcacatgatatgtctgcaagggtagagaattttgtaagcatcagttgctctcctctctgcttaccctgggaacaggccaggatttttccttgtaactctggtcctgaatgtggcagaagaactgaaatgtcctcaagaagaccggtctaacacgagctgacagcatgatgtcatgacaagaacaaaagttctgaggagcaccacaaatagagactaaaatcctagctttgttatttacgatagtataataataaggggaaattatttcccttattaatctccctgagccttcgtttccttctttgtaaaatggaaataataggagccactttcacaagattgtgggaagcagtacagcatgatgtttaagagtggatgcaaatcccaatgctgtcacctacttttaaaagactaagttccttgtctgtaaaatggggatcccaagagtaccaccttcagagagtgatgaggaggaggattaaatgagacaacacatccattacagtcatccatccctctgtataagcttggaattggttccaggacacctaccccccacaccaaaatccgagatattaaacttccacacttggccctgcaaagccacccacaggaaaagttggtcttcagtacaggcgcgtttcatacctgcaaaccctgtattttccatctgcatttgggtgaaaaaaaatccatttgggtgaaaaaaaatccattagatccatacagtttaaatctgtgttgttccagggtcaactgtattattattatgattgttgcagtaattaaattaaaatattgtaacaaaattgggccaatgtttaaaccttattctcacattttttaactttatataggtagaaagacatactggctatgctcaaaagtctatgtaccaccagagaggctgaaaaggcaagggaaaaggcagcttgaaggcaagttttaggactgcaaagcagtcctacaacagtatcctatttcctttaatttgggactttaaaaaagatctgggtaagcatttcaaggattaacctcacagcccccaccccaccacacttaccacttctccaaggccagcccgcacagccacctctcctacggagcatggtggccaactcaccattaatcaaccacgccaaatattttaccctcagtgcccagactcttagcctgccttctgcctggaatataaccgacaaaccaagtccccatccagcaaaatctcacttactcccgtaagacctgacaaaatactccttcctctttctctaagtttctcagtcagaatacattattccttccactggactcccataaagcaatcatgtgtatacctaattctagtcactagttaattactaattctggtcactagttaattactaattctggtcactagttaattctgatgtattttaataattgcctatttataaggctggctttcctttagatttcaagttttctgcgggaagggactctatcttacatatcttcatttccaccacttccccaacagaggctgacccgctgtctggcatattgtaggtattcaacacaaatttgttgaaatcatatttatgcactggggactgcaatgaatggagcccaaagctcacctcaatcacttggtacctcccctaatggctttaactcattgtatggtatatactaaatgaaagtgtgctttgaaaaataaagcataaagccattcatatctgaaaagtagactagtgcataactgagcctaggacatatgtagtacgatttcagtgaaaggatacaactgattggcagtttaaaaagtcatgttcccatataaaggtattatagcttaatgtgctataatgcagatccagtaaaatccccaccactcatttttaaatatttgaagacatataaggtaatgtctcaggaacacagattgattttcagtggatgtgctattaaaatgatccacttttcatatcataccctatgctgaccctttagacaagtgtcttaaactatactaaattatatttcaatcacaatcctatagcaataaaaaataaataaaaagaatatgcacctggagcgaaaatggaacagaaacatagccattgctaaacataacattttctctattttggtattacttttaaaaatttagtattacttttaaaaaattataccaagtggaggtattaaaattttcaatcaaagtaatatttgagttgcttctctaacagtatacgttgtttacatgtttttgtaagccagtctgtttcttcttacttcatacaatagtacttacagagagaaattatttagaatagtggctctcaatgtagtccacagatccctagggggcccccagaccctttccagtgatctgccaggtgaaaaacattttcatagcaatattaaaattgtatgtgcctcttccattgtgttgacatttgcacttatggtaaaaaaaaataagaaaaagaaaaagcaacaatggtaaaatcactgatattttacaatgaggcagacagtggtgccgaactacactagtagtcatcatattcctcactgctacacacttgcaatggaaaaaataaaaaattgctagtttcacttaagaatggccaagataaagaagtaaaatttattgattaaaaccttgatgtgtgagtaaaaaaacagtgaaatgtaaaactaaagcacttctgttccagaccaaagcatgacgcttgactcaggaggggtgggggagcatttatatgattgagttgtgatctgaattagccatctttttaatggcatgttttttcttgaagaaacgactgacatataaaccatggttattaagacttgggtgtttggaagatttttcttaaaaatgaataaacttaaactattagctcaagaaaaactgacagaattttctgccaatgataaaatttgggccttcgtataaaaatattttggaaaacttgcatactcctcaaatcaagtccaggttttctgatcagagttttctgattacactggtggtgatatcaactagcgtaatgttttgttattatacaataaaatgttccaacatttaaaagagatacataactcagtgaaccaatattttgcaaatatttcaaagcttctatgattaaaatatctatttaaagcacaacatagaccaatgaattttaagtttattgaactgtctcagaaaactgaaattaatctttatcaaacaatatttgtcagattttggtgtaataccaaagattatctgaaaatgttatgaaaatactcttatgttacaactagatatgtgtcagaccagatttctttacattcctcacccagaacttaacatggcaacagattgaatgcagtggaagatataagaatgcaagctgtcttctagtaatccagacattaaagggatttttaaaattgtcaaacaatatcactcttctcacaattttttattcttttgcaatggctatttttcattaaaatatgttatttattaacatgtaattgatttattattatttttagaatgtaacttattattttaaaatgaatcaaacacattttaaatgtttctcacttttaatatctgagataaataatcaatgataatgcacacaagagcttcctggaatccttaataatttttaagtgtaaaggtttgctaggaccaaaatgtttgagaactgccgatttagaatttatatgttaggattctctacaatttaatagaaaaaaaagatcatttctctggcaatgctatttttcattctgttgagtttgattcttatctgtatagattcaatgatcttcatgtcatttattcaacatttttcagtccttgctatacgccagatatagtggaagaaaccaggacacagtttctgttgtcagggtacttacaatttccattgttattcatattaagacatagtcatatattatattatattatattatacttgtttctcttctgtgtgtgtgtgacgtgtgtgtctgcatctgtgtgtatatgtccaactgcttcctaaatatcttcacttgaatattccacagagagctctcataggtccaaaactaaaattattcaatcgcatctgctcaattaatgaaaatgtattaccttgtactttgcttttgggtttttttccccctaatattaacactaggcataaaatgtgaatagtttgtctttttcttttgtgatgataaatcacagctgtgaagcttcattcttttctattctgttccacggtacaacctctgcttgtaaacatattctccctaagtcatgcttattgaatttcttcttgcacactggattttcacaagattattcctcttaccttgtgtttctctccttccgaatattaaataccaccctcacaataaaaagctatttagaattacgtgtacctgtattccatttatggcatctctataattcataagcaactcagatatataataaatttatatgtacaatagatatataacaaatttatatcttctgaaaattctcttttgatttggatatatttatttgccctaaagaaagctaagagaatactgcttattaaagtcacaaaggggccattataaaatattacaactagagttttaatgtgatgatttaaaacaaatgaagtacattcattttttcagctcaccagggaaaatatcaaaataaaaatttagaagattcatatgtatttaaatatcacatttcctgtgaattagacaaaaattatacaaataaaccttcaatgtatggccatggcaatggagacatttctgtgttatgccatagtactcatattactgaaattatattcataaactacatgagtcattgtatgttccctaacattacaaatctttaatagtggaagactctaaatttatgaataaccaggaaattcatccatggttatctagaatatagaaatgaaattttctgattcagatattattattgctttattgagaccaccatcataacagtaccctaaaagttaaaaatttttataattagtaacaaaaagcaaaatttaaactttttaaatttaatttttagatagtattaaaacgcattcaccagttttacacatttatgttacctgtttgactagtccctctaagaacatcaaattccctggttttgataatttgtaatcaagaccaaacaatccatttgatgatgacttactagaatataagcctagtaacacatcaagaaactacaatgactcccttttgcctacactaccaaatttaaattattctatttggttttaattaaatattaaatttaaatttttagatatttaaatatctaaaattgctcaataaagcgcgaaatgtcttgataacaatgatctttcatacaaggaatatgcaatataaattatacttcaatttttcagtttcatacttctatgtagtttataatgactgaatataaaagaaagaacacagtaaaccactgtgtagttactgtgttgttaatggtttcatgctaatatgttttgcttattatatttaaatgtatgtatcttaactcctaattgaaatatatttttttcatgtttagggcaaagcgttagtcaaatgtatcattggtgccctcccaacactatattacactattttcaacataacatatattcagtaccattaaatgtcaaatcacacttcaatttaccttggaatgcctggttacaagaggatagccgtatacatagacgttactttctcaaagacagactacttgtctgtagtttgctattactgtttcatgcttcataacttcaactacaaaaatattttgttggacaaaaaaaccacatttacatttgattttcaggcatttaaaggtatgcattcctagccacttgccctattatgctctgtggtcatgcattctgccagttttacacattcatgttacctgtttgactagtccctctaagaagatcaaattccctggtttggataaagattttataatcaagaccaaacaatccatttgatggtgacttactagaatataagcctagtaacacatcaagaaactacaatgactctcttttgcctacactatcaaatctaaattattctatttggttttaatactattcatattctgatgctaacatattaaccaaccttattctcattactaacaaaaatatatacagtattcactgtattttctttatgcttacctttctcaggatgctaataatattcttcctattttctccactttcataaatactatggatactttttctttcagttttgctttgagtaataaaaccatacaaatacaactgaagaattataaattttccttcagtccaattcttctccatcgcctccttgctttccagagataaacactacctcggtatttattattcctgtgtatatttgtattcactttgcatataagtttctatctacaaaaacatatagtatgtattaatgttcatatattttatattattttattgtgtcatattatcacactattctacaactagcttatatcactcatgttttctagatttacctatattggtacatcatacttaatagtaaaaaatgtaattatttctgtctatgataagaaaaaagacaaggatgtcttagtttgtgtttttccagtacaattcaacattgtaatggaagacctaaccagtagcataaattaggaagaagaattaaacatcaggcatattggaaaggaagtaataaaactatcttcatttgtagataatatgattaagttgaaaggcctaaggtgtctaccaaaaagcagctgaaaaaatatgagttaataaagattgctggacacaaagtgaacatacaaaaataagtttttccattaccaaactagaaatggttattttttaaataattgcactcacaagaccatcaaaaatatgaaataaagagaaatttaacaaaatatatggaatacctacatgctgcaaatttaaaacattgtggagataaattttaaaacatctaaatagtggaaagataatgttcatagatgggaagactgaaccgtaagatgtcaattctctccaaatctatagattcaatgcaataccaactaaaatcagagcaggtcgggtttttttttttttttttttttgtaaaaattgacaaacggattataaaattcatacatagatgcaaaaggcatagaataccaaagtaatttttaaaaagaaaaacaaagagaatttacactatttgatttcaattcctaatataaaactataataatctagtcagtggggtattagaatatgcatacacatatagacctttagaacaagacagcaaatccaaacatagacttacacatatgtattcaactgatttacaacaaaagtataaatataatacaatgggagacagtcttttcaaatactggtagtagaacaattaatattgatatttttaagataaacctcaagcttcacctcttatcatattttaaaattacccttcactggctaggtaccacagtacctcacacctgtaatcccagtactttgggaggccaaggcgggtggatcacttgaggtcaggagttcgagaccagcctggccaacatgatgaaacctcgtctctaaccaaaaaatgtttaaaaattagccagacatcctggtgcctgcctgtaatcccagctactccagaggctgaggcaggagaatcgcttgaaccgggagggagaggttgcagtgggccaagatcatgccactgcactccagcctaggtgacagagtgagactccatctcaaaaaaataaaaataatgaaataaaatcacctttctaaggatcacagacttaaatataagagctaaaactataaaacttcgagaagaaacaatgaaaaaaaaattcataagcttgagttaggcacaaatttcttagctatgaaagacaagtaagattcatttttagaaagttgacaaattagccttcatcagaattgaaaatgtttctcaaaagataccattatgaaagtgaaaagaaaaatatttgttaaatatataaacaaatattacatatttttatataaaatatatataatcatatatttaattaataaaggtctgattttcagaatgaatgaagatttttacagttcaaggggaagctgtaaataattcagtttttaaaaatagacaaaagatttgaagatacttgatcagagaagatataggaatggctaataagcttatagaaagatacacaagataactagtgaccagagaaaggcaaattagagccacagtgagtaatgactatacactcacgaaaatagctaaaattaaaatgactgacaatatgacaatatcaagtgttggagaggagtacagcaactgaaactgtcatatattgctgttagtgatgcaaaatggtatggtcactttagaaaacagtttgtcagtctctcgtacagttaaatgtcttcttaccatagaatcttgaacttctattcccaagtatttagccaagagaaacaaaagcatatatcctcacaaagagctgtacttgaactttcataaaagctttattcttcacggggaaaactggaaacaatccaaatgtccatcaactaatgaatgaatacacaaattgtgatatgcaaaaagggaggtgggcaatgaatgaactaccaatagacacaacacaggtaaattttaaaaacttcgtgctaagtgggagaaagaacacaaaatctgcaaaagatataactccattcatattaccttttttaaattaaaaaaatctactgatagaaagcaaatcagtgatttctaagaaatgggattcaggacatgacactgcagagagacaggagagaacacttgaggtaataaacatgttctaaatcataactgcagtggtggttacaccactgcatatatttgttaaaaaaatgaaacctcaaattgtacacttgaaattgatgggttttaccgtgtctatattttacctcaattaagccgacgaagaaaaaaataatgggctggaaagaaccttaatgtccactcctcagcctcaaaaaagtcatgaatgttaatatccaagcctcaaatatgactgtaataaactttcaaaagatttaccttgacttcatatttgttttagccactgtcttccaattctttaaaacgactctttttttggcttttgctcctcagttcctgttttcacttttcttcacataatctcacacttagagagaactagtctgactctattagtcccagtgttctgtctaaattataaaggttctttgctttctcttttagacacatatttttttcactaataagttttcccctgcttctacaaaagcagttatcattagaggtggtataccttaattaccatagtaattaccttaatcaccctgtaattaggactacaactaagggtgaagtgattcttcaaagtcacaaatcctggcttcaccacttaacttgtatgggtactagatgtatgcttcagtttcctcatctgcagaaataaggataaaaattatccctactttatattattttgaggattaaataatatagaaataatgcctagaaatctacctgacacatcataaggactcaataaatgttagcacttgtatcagtctcacattttccattggaaattccagaaagaatgaaagaaaaccaatgtgactaaataaggccacaaaatgagattttaaatctaggaattttacttaacatcaatagtcaacagaagagtcattttctgtgcctcttttttgtatggcttcttttttgaaaaaaaagaaaatattgttgcattcttaagtttctgctctgtattacaatggagagaacaatttaaacattatttctcagaaggatatttcttatacctattactaccttttctattgtgtgtgtgtttgccttgtgcatgttatgtatgtacatgtagttaaatttaccttgtcttaaagttaatttggggctcttcagaggacttgcattaattggagctgtgtaagcaacttgcattatttagacagaaaaactaggaatacccaagtccttccttggcttagccaatcctcctcctgtggaggtctccaaggaaacatacacacaaaagaggcaaaggaaggcaccattgcactttattactagctatgactttggcctgaaactccatagtgaaaattcataaactagaacagacaatagggagggctccttgcccctatttcagttagaaaagtgactcagttatataagcagggcctaattttgagttgaactggaccaatctgccccaggccttctcaggccagaagagtgatctttggtcagccactgtatgtgagaaagcacatccttagaagaaaagctaggaggcctgaactgcttagagagagcatctcactacctcattatcactggtcctttagggaatcctccaacaagagccttgctcacttgtttttagccaggtgatgactccacccagcagcaaagagttaaacctcaaatctaacccatccaattcaacctcttcctccttgcatggagtgggaggaattcaatgatgagatcaagtggagagcatttactttccattaaaagcttacagcagtcattaaaatggctatattggtggtcacagtggcatgtgcctgtattctcagttactcagaaggctgaggcagaagaatcacatgaagtcttgagttcaaggcagtagtgcactatagtatgcctgtgaaaagccaccacactccagtctggtcaacaaagcaagaccaagtctctaaaaaaaaatgactatgaaaattaattaacatttgactagttgttatccgatgtagtttgctatgctatactttccagaagcttcaattaaaatctaggaggtatttgcaagacaaaatattttcagtgttcagtagtgtcatgttcacagtgtgaacttcaaggaaacactttaaaaatcagtacttcctaactacagtagggtatagtacagactcatgtagaagacatgcctggaccctaaacactgtgagaatagccataaggatttccatgggtttctacaaagtgtttactagatgatgtgtcattttaactctaaagagcaaatcatactttgagaacttcaggaaataatatactttttagcacaaagggctctgactcccatgacagaagagaatttactatgatggttacacaaatctcttttctgtctaaaagtttttgtaccagcttttcctaggctcttatccttctcacaaatcaggactcagttcaaatatctctatcttggtgacactttccttgacttccctacctaattagtcccactctcctcctctgacaatatcctgtttctgcatggaaatactttacattttgtagttgcttgttaagtatatgtgttactaaactgcatcctcctgaggacagggattgtggtttgctcattcagctcctaacaatgcctagtatacagtaagcactgattaataatctgttcaatgactagcttgaggaatggatgcagatttagcaattttaattggctatcgtcagagcaatgtcctcttttagctcctttgatacttggagcattgaacatagaattgaaaattttggatctagtcccaattccttgactatctgtgagtcttaaatatagtgaagcatatatctagttcacctacctagttaagtggtagagccaggatttgagaccttgaagaattacttagtctatatttaaattttatatatatatgtctgttgtcaaatggcataataacactcttagttgctctactacacaggacaattagggctaatgacagaatatacgcacgcacacacaggcatatatatatatagatagatagacacacgtatatacgtatatatacacacacatatatacacacatatatgtacacacaaatgtatatacacacatacacacacatattaaaactaaaagcattaagatttctgaaatttttattgtaatttgaaaaaattcaagatgattaacagttaaaatgatttaatatggttaaattttaaatttatcatcaaagaaattttccactgagtattgaaataagaaaacctgaggtacttattaggagcttatcatctttatatatatacatacattagtttgaatataaatcccaaatgatgagattattttccacctcaaatactgaaagaatgtttattattcaaacatgggatagggaaaaaatacaaaataggcaggcagtttaaagcaatttattatttttctaagtgccatatagtgtattttattctacccctccgaatctacattttaagtgatctgaatccacactggaatgcatcaatctttatgtatttgtgatatcattgcctttgccaggaaactatgcaaagacttttcaatcacggtgattaagtattcatattcccttgtctacaaagagaaatacttaaaatcttagggaaccaccgccggataatgatatggcatttaacagttttttttcctaattcaaaccaaacattagaaatggataggctaatcaggtattattatttcaaggaacgcttgaaatgcacagggttaattttttatgttagattgaatctgttggcatagtcccttgtgttatcaaatagaatacctaaacttgtatatgtcaattaaacacctttcccatggggccattcagaatgcagtatttaaaaacctgcaataaatcgctaaagttttaaaatagctcattacattaatctgcaacagtatcatgcctaaattatgatgctcttaaaatgtagtaaagtagatagatgttgtccacagtactctgagcatatttgattcttgttcaattcttaagattaaaaacaataataacaatataggtagtgaactggctctggaaacattttcggtaaatgccagccaaaagctaacacaagctcaaatgtcatttggtttatcccagtcactgttcaaagatatgaagcaattcaaaatctacttttactcaatatctctatgaagttagaaaaatttatcttgacattggcaagaaaacatatcctttctttacatatatcattttattctttttatttatttcttctatttctatataaagagaggtagctgtgtgtttatgtgcacacactccattgtaaacttaaaagctgttgttattataaattcactttctagttagacctgtggtaggacttaaagctattcagctgaaaccattctggagtttgcaaaatatgctattttattttcataaacattttgtgtctggaggctgctagaaaatttatggactggttattttctgcttcagtaccagtaaagcacattgctatcatgctcaaaagccaaaagatggtttcaataatgctaaaaagaaaaaaaaaatccaacacaaaatggtgtttgtttattcatatattagcatatcattgtccaaagtagtatcatttaaactttgtagctcatttgaaaggttcacatagtgcaaaactgatgaagcacataacccgtaaaggtataaaaagaaagtattatgcatacattgcaataaaaatctcatttttttaaacaatatctgatagtttgtgcctatgcacatagactgtttaagatgaaaagaaaaactttctcatttaaatctactagttaattgcagtctttaacagtgaaaatgcctttcctctccctcaccccaagatagtttctgtgtataagaagtgtcaattctctttatggttttggctgaagtttatctagaaggatcagagagatatacccaagtaattcttatttaaatactacctggaaaaaatgtctgaaatgtcagtcaaaagcttttttttgcagacggctgatgtcatttcagaataaatacggggacagaaaaatcagaaagcacttatttttagaaaaaggagcaatgtacaatcaagaacactgcagttttctcaaatgtctctttagcactctagaatttattgactctagtatgtgtgacaactctgacagctgtcgttaacaactaagtgaagaaaagcaaatgtgttttcctccctggtaaaatgaaacaattacatgctaagagaaagaaaaagttggtaaccttatactgatgtttttagtactttggaactaccctagagaattagctgggagagtatgattttcttctttctcctcagtgcctaggacagagactgacgggattagattattttctgatggtgtcaattgaaactgaaacagatgtaagaatgctgtttcctagaagatgaaatatttcaggaattacatttaatattcatatggattaatcaggtgctcaacagccagccaataaatcctatgcagtaatattttccatgggtaattcttcaattcaaccttattagtttttatttatttcatcatttagacaatatttatgttccttcagtcccaacaatcacaaaaataacaacaacaatgatacatacacacacaattctgactacaaagaacacttgacttcacttttcatgacatttgaacaattgagtatgggcaaaagtttcatcctcaaatctctaagtgaaaaaaaaggatgggttcaacaaatagtgctggaacaactggacaaccccatgcaaaaaaaatataaataaatctaggcacagaccttattctctttaaacaaacaaactcaaaatgaatcatatagacctaaatgtaaaagggaaaactattaaaactattagacgataataacatagaagaaagtctaaatcacactgggtatggggatgctttttagctacagtaccaaaggcactatttataagagaaagaattgataagctgggcttcattaaaatgaaaaacttctgctctagaaaagatacattcaagagaaggagaagacaagccacagactgggagaaaatatttgcaaaagacacaactgataaaggacaactatatcaaaatatacaaagagcccttaaaactcaataatagtaagatgaaatgaactatcaggccataaaaagacatggaggaaacccaaacgtatatcagtaactgaaagaggcaaatctgaaaaagctatgtactgtataattccaactataagacatctggaaaaggcaaaactgtggagatagttaaaagatcaatggttcccagagatgaggtgggaagaaaatatagataggtggaggatagaggacttttaggtcagagaatgaacctcaacatagaactatggatactcctatacattccactcaattttgctgtgagattaaaactgctctacaaaatgaagtttattatttaaaagaatgacgataacaaaaccaagacgagaaggttcatgaaggtaatattttctttaccagtttcaaaaaaattatgggtattgtactaaaatgtaaacctttataaatttaaacctcattaatagatattaaatgttatttcataaaataatttcttcagctttaaaaattaaatattgaatgtctaacaaagtaaatttaaataattgaatctaacattaatagagacagataatggtagaaatatattttatctttattaaaaattgctgtgaaatgaagccggacatttaaaagtacagattatacaattttatttatataaagtttaaaagcaagaacccctagtctgtgctatcaaaagttaggagagcgacttcttggcgagggtgtaatgaggaatagagaacccaggaggattttgaggtgccagctgaggatttgggggtttgttttggtgttctggattctgtgtggggtgctttcaatttatgaaaattcactaagctatagatttactgcactcttctgtatgtattttatactttctctaaagttaacaacaacgaaaagccgaacaagacctggggaaaattagagctttcttaagcaggattgagtataaattgtacttgccaaaatgttcatttctatttgaattacttttttaaataaatagggcatatgacttttaagtagttctgtcatgcagaatccacttatctctgttctgtgagcatggacaactgagtcagctgggcagtgctacaaggacttttctctgattgagttgcgtgtgatcaaagggcaacagtttaactctgcaaaggaaagagggtctctttcccaggcaacgactaagtttctgaagagactcttaagctaggaggtgtattatattctagtacacattccctgaacaccttttcaaccaacaacctccaccttcttatctatcctatccttttacttgaggccagatatattcatataggttttaggtcattttactcccatatcttaccctaaggttctaataagaaatcaagggttcaggaggtgactgcaagagaaaaaagaaagggcaaactaaaaagtctaaaccttttgggaatagatgaataacaccttgaagaaataagaaattaaattcagatagcacaatattactgattacaggagatttatcagatgctttgaaatctaaggcatgtaaaggaatttgtgtggatgggcatgtatttggtgagtttttatgtgtgtatgcttgaaattcagtaaatatatactgagggtttattgtcaggagcagaaaaaaataatagttaccatttattgcatatttacactgtgccaggcatcgtgttaagttcttaagcacgaattatctcattaaatgctcacaataaagctatgagctaggtattattattttttccatccaaagatgaggccataaaggcttataaaatataaataacttatccaagatcttacaacattagtagaagagctaggatatgagctcatgtctgtctctgaaaagttcacgatcctagcctcttactactctctcggttactgagtgatcacaagggcaaacagagaaatactggggagaaagaggacaagaggagagaaaaagaattttaagatataaaggaagatgaagtaaaagaagtgagagaacagagaaaaaatacaaatggcacagtttgggcacacaatagacatttaatgaatgttaaatgaatgtttttgacatatgcacattaaataccataaatacatacttacagattttttaaattaaaattgagtaattgttcacttagcttagctagagacaaggtgtttatatgagtcaaaagttattttataatcattttaaacacatccaaaagactgggaaaatcaaaatcccttaagcatagtaattaggcacaataatttaaaggaattttttcattaatgtccctcactttttctttcttttccttttttctttttctttttgagacagagtctccctctgtcacccaggctgaagtgcagtggcgggatcctggctcactgcaacctccacctcctgggttcaagagattctcctgcctcagcctccctagcagctgggattacaggtgcgcatcaccacgccgggctaatttttgtatttttagtagagatggggtttcaccatgttggccaggctggtctcaaactcctgacttcaagtgatccacccacctcggcctcccaaattctgggattacaagcataagccacagcgcccagcccctgtccctcactttcaaactaattttgtgtttaaaccttaatgtaattataaaagttaacagatttaaagagaaaaaataatcaagtctccattataatttttgagtagattctttctgaagcaaaatactgctactgctaagaaaataattatccctaataacatgggcgcaattccattaaatacgttccatcaataaaaaaagtaatatataattttgaagaaacaagaagaaataatgaaagaatgaaccccacctggtccattctagattcattagatgcccatctcagcagtaaagtactttcctatttaccttaagaatgtcataaaaacattcacatttctgttcctatatccaaggacctggcactgctgaaaataccctgttggttggtgctgtggcagaagcatcctttccaactcctgccttgttttcacctcccaaactaatccttatatgtagtactttctaagtctgcatctttctaaagattctcaagttctcagtcccaacccactcatctcatcatttttgtaagatgacccaagcagtctaaatattctccatatattgtacagtttatatatttttaagtattgtctatgtatcatcaccttacatttaaacttcataggaaaccaaaatagattagtatatatatccttatcagctttttttataaatgaggaaacaaaaatgtatagaggttttgttgcttggccactattacaaggtgttgaatgttgtaaagctagattcaaactgagtataaaatttgtgtttctgatcgctagaaaaaatacaaactattagacataaactccttcagaaatttttcccaccacctcaaatcttctctgttcctacatctgtttcctcatttttcattcaaggctcattactgcatcccagtttagacccaaggtcagccctcaattattaagcccatggtactccacctctctccaggatttatcattcatcctgctttttttcaaatgtgatgaagaagaccaggaattacaaaaataaagaatgagtaaaagaagcccaacacaatggatgaagttgagtaggactctaggaagagctagagtaaaaactgatttgcttcaagcttttcttcaatgctggctcagtcttggcccacatgtaagtccttatattttaaaggagaaataagagattgataaaccttgtccttcaaaactataaaagaaatcagactttgaaaaccccacagtttaacacctcactcggttagaaaacagaggcaggtagaattacagtgctaaatttcatggtgatttaatgggtaagattaatactttacagctagcttgatgtttccttcatcagaaacaaaaaaattacttgtgaattgacctattcatttctaaaaatatttataaatttttaaaaagtgaatgtatatacagtaatattgattatatagcaataagcagagacttcaagaattacatatttccaaattattaatttcctcaattgtatttctaatgagacaattattaaaggatattatttttagatcaacagataatcaatcatatttgactttatttcatttactagacaagtaaatttaatcataaggaaattatgcaccataacttcaagagatgatgttttatgtcaatttttccatataatgaatttctgtctcattttctacttataaaagtagatgagggcgggctcgatgattcacgcctgcaatcctagcactttggtaggccaaggtgggcagattgcctgagctcaggagtttgagaccagcctaggcaacgtggtgaaaccccgtctctactaaaatacaaaaaaaattagccggcttggcggcatgcacctgtagtcccagccactggggacgctgaggaaagagaattgcttgaactcaggaggcggaggttgcagtgagcggagatcgcaccactgcactccagcctgggtgacaaagcgagactctatctcttaaaaaattaaaaaaaaaaaaagtagatgaaatagaaagtagtgtcaagttgatatatcaatagtatatatactaaaatactgaattatctccagtaatgaggttgtcacaaacagttataaagagagatcattggggaagttaagatacttctttggtttctagtcaaagcacagtacctagaacagagtcatcattcaaataattctgtatttccttcctctatctttgacttctttccatttcacatgtacctttactttcctattttagatactattttctcattgtgactactggaactatctcttaaacataccatcgctgcctttaatctcagttgcttcagttttcaaattgctgccatagtttcttttctaaaacacttaccctagcacttcactgtcctgctcaaaaagctccattcctttttccctgctgtgtcaaattcaaagccaaactcggcacaggtttctaaccaggaccaagctcatcttactgtctcatcacctgactgcccccacaaccactgtgttacattcttccacagtggatgctcaactttcttagaatgtgaatgctcttccctgtcttcaagctattattaaactgccttctctgtcatgaataccttttccacatctcgaccaccagaagaaatgtcactttctatttgtaacttaaattagatgtcacttgctctctgtgttgtaatctttaagcttcccttatgtagtttcttaatctcaaccttatactgtgtttgtaaatgctcatgcctctatcatatcacttatcaaattgaattattgttagtaacaggtttctgtacctccactgttaagctatgaaatttgacaactcacagaaccacattgtcttaatctgtgtattctcaattttaaaagacacagcactcttgtaaaaattaggtaccttagaagagaatcaataaaatatatgtaaaataaataaatgatttatgaaagataaacatgaacataaactaaagaaagacaataagaacactgataggcatctattttttttttcttgtaaagaacgcctttgactttaaaagattatgtagagaattcagacctggaagagaactcaaatattagatcattttagtataatctttccatttaaaagatgaagttgagaggcttggatgggctcgcaacacagaaaaatggcagaactaggggaaaaaaacctaggatcccaaatacacagtcaacaccattatatagtgttatgccaactttactgagagtcatacagcatatttgaaaaaacaaagacatttcttgtttatggacagaagagctaagtatgggaaaaacgttaattctttctgaataaatctgtattcaggcatgttataatcccagtagaaataactaggcagtattttctggaattttaatagtattttaaattttaattatgagagtaaatgagcaaaaataactagagtgattttatactatacaatatattgttggtgggttttagttaaaaacaaagtgaaattgtgatttgtttttttcaatgaattactgtaaatataattactgttaataattttcttagaatacctttctagaaataagaaaataagaatttgatatgtaccaagcaaatgatctccaaaaaaacaatgctgatcaatataatacattttagtaactataaatgtttaagtcttcataaatttgataaggggaaaacagtctctcattgatgaattggactttctttgattataagtgagacttaacatttttttcaaatgtttattaacatttacaagttttgtcaattgacctcttagagattgcatagtttatatcaattcatgtggctcttttaatgtttaggatattcatgttttgacacaacacccccccaatgaatccttataatttccgtttttgaattatgttcatgataatttgtaatatccaagtgttacatttttaaagaatcaaacatggcattttttaaaataatttcttttactgattttaaactttcccattcaaatcaaataaaccttcgcctacattttcttttattcttttgcttctttttcacataattctaaaataaatttcaaatggataatactttcttatgtggaaaaatcatctcagttgaatctactgtaaactcttaatcaataaaatgttatttcccagtgagttctaaaagccaccattatcatatgataaattcatatatatatatatatatatatatatatatacacacacacacacacacacacacaattgtagaattatttacttatttatcatcattctatgtttctgactatttctatttggtttcatttatcacatgtctattttggtactagtttcatactggattgattattgtagtttatcacatgtctattctggtattagtttcatactggattgattattgtagtttaacattatgcttaagtgttaaatgtttggtaggaatatttttccttaaaatcactctagttatttttgctcatttactctcataattaaaatttaaaatactattaaaattccagaaaatactccctagttattctactggaattataacatgcctgaatacagatttattcagaaagaattaatgtttttcccatacttagctcttctgtccataaacaagaaatgtctctccgttttttcaaatatgttgtatgtctctcagtaaagttgtcttcaaacaggttcaatttattccaaaatattttaaataatttttgccaaagaaaaaaagcgttccagttcccatgtattaacaatgacttcttaatactatgtagaaaagtcttaatgttctaatattaatgttacattttatctttctaatataattattgtcgagatcaaataatttgaaaatcatcatgaagtaatttttcccttatagtaataatctttgtcatttttgtttcatgtttatcacactggttaaaactgatagaatattaataatagtggcaataggtttgatccatctcttgataagagtaactataaatataaaatgttatagactgagaaagatgtgctttatcatgttaaatatttgttcgatttctagtttttttgttttgtatttgtaacataaattaggctaatatttttatcatatgactttacacaatcttatgaaatgtttattattgtcttatttgacctattagcatgattgtagtatattttctaatgttaaactataattattcctttcagatagcttaaaggtattttatgctaacaaatttccttcaaaatcagactatagtgttcagagactctcaaattgtatatttggaaattttgcattaactctttgaaatcaataaggtttctaaaggaaagaagatgctgataacttctatctatgtactggtctctacaatctaacaaacgtttccatattattcttggaatattgagcactgaaatatttagatcacaactcactgctgagtttagggaagctgctttcttcctcttggtgtcagataattcaaccccaatacaagggtttgcattacaaaattctgaagttgactcttctctccaattatcacagatccttcctgattcctgtctccctcaggctaacacaaactcatccacctaaagaagcaatgagattcagatacctagacatcacccctctctcaggtttccaactccctgcttaagctttccccataaggcacttacagaaactttctaaatgtcacctttttctatagggagtggtctgtgacaaccaagtttgtactacttcctcctgtacactgataatctggaacagatctgacatacaacctaagtttggctaatgagattcaagcttccaagaagctgacattgagacttaaaaaaaaaagttagttttaacaagtgtcttaaagaatagctaaaccctggaaatggagatcctctgctatcctgtgaacctagaagaagagaaaaccaatataaagagaaacagataaagcagacagacagaaagacagagatgctttttttttcttataggtttttatttcttaggaccagttctttctttagactcgtttctattcccgctatgcggtttcctgatgcacattcacaaattcttaatttcagcttaattaagcaagttttagttggtttctcaagttggttggttacatacaatcaaacaattcagattaatatgccactgtgcttgacctgccctgatatgagctcagctatagggcaagggagtagggaggtagctctgaaattctatccaacactttctttatgataaataaggttctcatagcaacagaaaaatctttgattctatacaagatgtacagaattaatattttattgcctatagatcagtctggagtaaggaattgacaagttcctaaaatatctaacctccttttctctatatttgttgataaatcttagggtttaaaaattatagaaataacattttgttcagatagcagcaataaaagtaaccctaaaaggaaagtctttgtttccttctggcttcccaagtagacagaagatgttaagaaaacttgtaaggaaaacatgagtaattctggatacactgtgattcagaatgtgcttaaaatacagatgcagaagatggttcaggtacctttttttcagtgattttaaaaaatcagtttcagtgattacattcaattaaaccaccattgtagcttatgtctttgatgccaattagtactctacagttcagcagtttgactgaatattccagctttagttagttattttttaatgaaataattctggcctgaaatactagtcatttatcactctaaattctaacatattctttgctttgtcaattaaatgatacactggaagaagcacaatcttttacatatctttaaaccattgcttaagtaagcataccacatacctggttacaatgtgagaaagattaaattttaagaaacaaacagttctctttatttttgtaccaactgtctgatgagcttccagtgctctggctacttcaccttctgctcctataaactggaagcagaatcttcctccacaccgataacgtggttttactatcccaaactaaaaaggagcatacaaagaaatgtatcctgatatctaattatgtcaaaaagaactaatttaacaacaattttatctatacaaaaattaaacattgggatagccactattcaattttaaatgggcattactaagtaattccatctaatgggtcaatttttttaattccttgagagtaccttttgtagctcactgatcctggcagacaatctagaaggccacactgtacaaacttggcagttgccttataaagctcattctttgacaactggcaatagctaggctaaaaaccttctaatatataatgttttttgttgtcgtgtatagtaagcagctctggttctagtcaagcacatctgggttcttcagaaaattaaaaattggtcctgagcaaaccttgttttggccaatggcctccttgcacttttggtgttagggaggtgggtcagctgtcccaccaggtgagaacactggctatcaccaacataatcaactcaactggtttccaattaacaacataacatagctgttttctaggttcctaacagctaacacaagctccaaaagtctacttccagctgctattaaatccctgcgaagagcaatgatatgtgtgtaagtctgcagattgtatgtgtgcttcatagagccactgggactcttcaaggtacttccgagaccagtaagcaggactaaggaagtggaccagccagggctatgccaatcccttaacagttcttgttttttaacagattgaaatgttagatttctgagtaggatatttttgaagatagagtcttaaaactagagtataagggagatgttcttcatttattcttcagagtatggtacatccccgtatcatcagggctcaaaagagttatacatctaaatcaaggatgattatcttcctcctccttggaaacatctttaatgaaatatactatactttcagtgttataagagttacatcatttcttaactttgattgtgggtacaaatgcaaaacagccagagaagacttctgcttttgctgtaaaattttgtaaaataacattgctcatttggctgtcaaagtcgcatatgacacctttcttttggaaataatttccaagaaaatgtgttctctcttgaaaaataggtaagcttgcttctatcatataatgaaaattataaatcacattgtcggtccctttatgctttgactgcttaagaagctcaaaagttaatgatttcatcctttattctgcttaccatatttgtttcttcctcctttagtagttttgatggtgtacttttatttgaacagctttgtgtgtcatttttatcataaacagaatgaacatgaatacataagtcaataataaaattaaaatgtgatgaatatcctggaaatcactgaaaatcaacagaattatgtattctatgatcatttgcttatcttcaggtctcttatcctgtattatcagctactggaacacaaccaagactcaagcccagcaaaatcaatctccaaagagctcaaagagattgtcttttaagttcatatactaagatttatttattttccataaccctcatctgagctatatgttgccttatatcagacacagcacagttctattatgctccaataggttcttgttgctttcgagatgaagaacaaaccttaataatggcctataagacctcacatggtattcatggcctggcctattgccctacccttatctcagacacctactcccttcagatttcatctgttcctaaatccctatattagggaaatgtccactattataaactctaaatccagaatatctcccttttcagcactcattgcagattacataattatatttttgtgtgcttatttgattaatacctaagttctccaggaaactcgaagtgccatgaatgttttgtctatgttccccagtaaagtatcgtcagcacctgtcctaaaaacaagcacagcaacagcagcagcaacactttgataatgtaaaaaaaaaaaaaaaaaaaaaaaagtggacagaactcaaagattattggagtctagaggcaaatccttttaatagccattacattaagatattctttaacagtctttaatagtatcattatattacaggatggtataataattataataattgaagtcatcaaggaagggttaggttttgatcatggttaagatgaaagacaaattagtaatttgcctttaaaatgctttctttagtgcttctttaaaagacttccctgtcttctggaggtgagcttcagttctatggaaacttcactcatctgcattattcttcccacttcttaactagcaatattagataaaggaagtgttccccaacctcaggttatggtaaacaaccttgtattgcaacattcctcttttgatcaatttcataattgcataaaaattattttcaaactcctgttagtgttcatattcccaacaaaaagattaatgttatgtaatgtttcacaaatattctgccacagacgatgtgtgttgaatttaaaccaaattctgtcttaggttgcctttaaaggaaaaatgcaaaaaaaaaaaaaataaagaagaagtttccacttgaattctaaattgaagatgacctcgtgcttttctgagaaacgctggcaactgaggtcactggagtgtgttatgatagacggtgcagtgctgtgcgtgtctcaaggcatgtccattgtatggattaaagccaaaccaaaagtattagacagctcagagcattctatcatttcatttgaaaataatgatcaaagtcatgggcaacaaccattgcaactctcatgaaagaacagcagcattcaataattccatcacttcagacaggcagttgggctattttcaatcaaatactgtgaatccagtatattctgtatcagtttctcgtggcagtcacagaaacaacatttctgcttttacagtataaaaatcctgcctacattgtgtgcatccctttgcttccgaaggactgagtcattgagaaaaatataaggaaacagaaaacacagaaacttaacactcgttgagtataaatatacagcaactccaagtcatccattttcttcaagtcaacctactgtttcaaaagcttaaaatcagtttcaaaacaaaatgtctacaatctcttctctaataatgacatgaacaaaacattttcaaagaaatctaatgtcaatggtttcaaataagccttctaagtgatctcttcaatagtgatatttaagtaaaacattttgattgacagaggcttattttaaacttttgcctccttcacgcatagattaatggtagcataaaaaatatgtttgagattcaaaagcaggtggaaaaactcacacttctaatcaaagaagagaactgcttctaatcctgtgttttccactctgcctgggtatcttctatatataggaggaaaaacacaccctgtcgcttttaatgtatttagacacacacacgttgtaacttaccattaaaatttacagcccgaatataaccaagtagctctttcccatcaatggtactcattcgtggacaaaggccaatgtatccagggcagagatctttgtgcatattgtgcagggcgtaagccatggaatatacagcatcaattacaaattggacctttccttcctgttcataagatgaatcccgagcaattcgctccagccctgcaaaataaaaaagtaaaaaccatcagttgatgttagattccaataaaagacagcattagagctaagatttccatcatttgaggaacacttaatgagacacgactatttgatttcacttctgattaattctatacttactgagtcaggtttttaaactggatattaagtttatttggaaagagtaaaactatttcattagcaacaaaaagatataaagtaaataaaagatgtatagtttcattatcttttttccaccttattgagtcctattatattgtgcattctagtaattacataacattttggtagtggcttgatcttttaagtaaaatgtgcagtgtgtgattcttgccatctgtctcagctccaggagtgtcatttattagtggcccaaagtaaggtctttcaccacctaccaaatcagttctaattttgaatgtgctccatttgggagcctttttgtaacttttatatgacaatactcccttaagtgaccctggttatctttataataatcattcaatttgttttctttttgaactcaattttctatttagaatttctgttaaaaagatgtagatacctcaaaatgaatgtcattcagaataaatgtacctgtgtttgggcatatttagggctgctcattggcactggagattacttttaggttggtgtttataatttaatatggaaaagaaatatattttaaatgaaatataaatgagagatcaactatgatccaacattatcattttgaaagcgaggaaactaagactcatggagattataattacatggggtacatggggtacatagggcaggtgtgggaagcattcgtaggtctcagactgcaagcccaatattctctcaatccccagaaaaatttggtagatggcaagaatgttgggcatacaagaaaaaattatgaaagggacatcaagagtttattaagggaacaaaaaatgatctcctgtcacttctacatccctcaccaacccttacacaactggtaacacttagacaaaagcaagtattttaaactttccatggatgttactaaccttgaataaattgtatttaaattcaacaaatatttgttttctgaacatcaatgcatataacctacatatttagagagtcgaattaacgtggtttatatttgtatatttacactctgaaaaactagtttttttctaaacaaaaatagtggtcagtttatttatttttattcatcgaattattgtttttgttcttcctctggtcttaatcacttgtgacactctgtgcttttagatgctcttggttggtattctggtctctgtggtctgtcatgatgctgaattctgctcctccctgtttggcataggttttccgattttctcatgtctcaacttttcattctccaaggctgagtttcttcatccccaacctcagaatctgctaattgtcaattttgtcaactactaaaatttctacagtctagaaatataaatcggactataaaatgttgactacagaatccagaacattagatcaatttataataatcagtttacttcattttggaagttagctttttggaaaattagttttctaaacctttcttgccatctaactgctatcgtcccatatttccaatggcctaccatatctctacgtagtctgctgcttccatatcaaacaatatatgtaaaacaaggctatctctgcaggggattccctaaaatatcctactgaaagttttgcaagtttgcgagcacaaagagacagggaagattacttctcaaaagttatattgtctccttcaacctaccccttagctgcatgatctaagctaagatccacaagacatggggactatgttctctccctatccctaggttatacttttgtctcctgagtcttagaacaacactgcttgttcccagaatcattcatcaagtttcctgtgaaaacaaccctttccacttctgcctaaaatttctctcccatggctttaaccacaaagtagatcattcataagtaaatactgaaggatggttacagcaaccaaatagacgctgttatttccgtatagattctagtctggtaactatcccctcttgtttagtccaggactgaagggcttctcaggacctaggaccaaaacctgaagagcccccggaaaaccaggatggttgcttatgaacaaagaggcaagtgacgaggaaatttcagagagaagactgaataacaactttgaggatcagtccctaggtctggatggatatccctgtgtttcatttattttgcatcgctgaacttgataacggaaaataaagacagtgaggttcagggcagttgtttccacacttgggtctctccttaagtacagatttctcagcaccaccccagacttgctgggtcagaatctccctacttgggacatgaaggatctgtcatttcaacaactcgccaagagattctggtgcaaccagctgagtctgtgggccagctttaggaaatttctgctcttccatacagcaatcctcaaaaataccactatagatctattgtttagagaattttatggtattgaagtatgaaaataaaaataattctttcatgatatgcacaccccgaagaaaatctaatcaaattcttccccttttctcactagatgaagagtcaaagaacacaattcccaatatttacgcatttcaaagcttccaccatgtccttagacacacagggaggcctggagctgatgacaagggtagaagccagaaagacacgaaagatctgcaaataagaaagaatttcccatttctcaggatagagttcagttttctaagttaaaatgtcagagggctaatttaattgtcctgaaattaggcatataaaacttctaacatcaatgcaatgatggcccaataagcaggaattgaatgtgttcctcctgagagggtggaaacagaaaatagaaagcagtaggaagaaaaagatacagagaggagggaaaggaggatgcagcaacacagagaaaggcttgagcccaaggtacaataatggcagagggaaatctaacgttccaggttgtttgtattgctgctctctaaacaactctgctgcagacacatacaaacacacacacacacccctcacatacctcttctgtaaatattatttgtttttaatctaattattttttattttgtgggctttaaagaaaagggaggacttccatgtttccattactgcagggtggtgaagggtggagagtggacacagaactggcagaaaatgcctaagccaaatggcttcaaatgaagcaatgaccacaagagcattaaggaatttggaaattttttacaacccatggaattcatgtaacagctagacatgtgtgaatgttttatagtttcaaacttactctatcctaaaatgttcttgatttaatatattatcattttagtgccagtgcaacctcaatttaatatattatcattttattttatatattatcattgtattttaatgccagtgcaaactccctgtcaatttataaagatactcctcagcattcaataatttcctgataaattataatcgacatgctccaatttaatacatatactcttcctcagcatttcttaaaaaataaacagcctggtgtggtggctcacagctgtaatcccaacatttcgaaaggctgaggtgggaggattgcttgatgtcaggagttcaagaccagcctgggcagcagagtgagaccctgtccctaccaaaaaataaaactaaaaattcaactttatatccaataggtctaaatgaacaatcaaatacacataatcttattaaagaaacatatttaaaattgtactattcaaattattcattttcttttctagttataaactccaattattttgactgttgattaaacatattcaactttgtacatttttgttcttttaaagagttcagaagtctgcctagtaactggtgccacatgtgaatcaatgaacactgtaagaatctccccataaatcaacataagcatatggtgacaaactgaaagactgaatactattaccatttctaaacttaaaagtggatcatttgatttcttttcaggctgtttagacaatgtatttttctgttccttaacacttcaacctcatgatgacacttaagattttacagcagctagaatttgctcctcacttcctatatttgattctctcattcatctaaaagaggagtttaggaagctgacagtgactcatcaacctaattggctgtaaaatttcattatgctatagtttctaaagttagtgttaacgtattgctataaagtgctaaatatcgtcaaaggctttatgtcagctaaccattttaaatatcaccgattgtaaagttgtgatgtgttttagtgtatagcttaaaattaacaacatatagcaaagtgttttcatggtgagagaggaagtcagcctcctaaattttatgggaagattgttttacatcttcattaatgaaatctaaatcttgtgactggatctcaagttcctggaaaataataaattcttactggtctaagaaatatcacacatactttagttaaggtctttcacactttgtggtatatattcttgggttttgttccttttcagtaaaaaaggcaaattgacttaagttggcaaaacattgtatatgttacaatgtaagttcctaaggtgagcctaagagaaatttcagactttgatgcattgtggttgcaaagcattgctttctaagaatttcccatttctcaggataaagttcagttttttaagttaaaatgtcagaggactaatttaattgtcctgaaattaggcatataaaacttctaatatcaatgcaatgatggtccaataagcagttggtcaattcaagtaaaaaacaaatggaagtcataccagttgcttaattctggggaaatcaaacatccaattggttgcctttttcttacaaccatctcagcttggagtataaataatcccacaatctaaatttgtagattaagaagtattttttaaagtttctccctgaatttttctgaattatgaagcaactattttaaataattaagtcagtttcttggagttgctctggagagaatggtagaggaagaagggaatttgtgaacctgctatgaataaatacatttatgcatctaggcccagatttagaagtcattctgaatttcacaggagcttctctgcctattgataaccaggaataagactgtcatgctttacattgtgcttttcccaatgtgacacagatatattgttactgcatagtgcagtgacttttaaatccatgagaaccatgccaagaaccacatcacacactaaagagtgagcgctatcaagctgacaaataggtttttttttttttttttttttttttttttactaaatttaaactgatttgggttccaggatacaatagggggaacataaggtagaaatacaagcatgttcaattatacaggaatatctccagagcactaggatccacacatgaaagtgtgcacctcccatactgaagacagatgaaaatatgaaccctgagatgagacagaaaggcaaactgactgatagaagcagctggctaggggagagagaggatcagtcaggtagatctggatccaggtcccagctggacagcttagaaggcgagtggccttggacaccttcctgaaccatgtcactaatcctgggccttcagctggcattgccactcttagggacctctgtaatggggttcctcatccctccagcttcatctgctgcaccacacacctctctgctccactcttaggtccttgaatattacataagatctccaaatgcaggcctttattcagctgttcactctcttcattccttgcctagatgtttccaagcctcaggggagatgtcacctcaaatttgttaatatttaatgattttcttcccaaacttcgcctagattagatcatcgagcatcttaaatactaggcttaaatactgaatattgttcacttgaaatggagaactatgatcaatatttaaaattattgctgagaataatgtgtaaaatcaattgaagcaagcataggttgaaggtagagataagttgggaggcaggttatgcagaaagtggaaacaggataacccagggaagtgaaaacaaaggaatgagagaaaatatgttttagaggccaaattgacagaatctaactatctgattaaatatggcagtaaatgtcaggaggcaatgaacaactcagggttctgatgctaggtagtagaaaattggcaccatgaacagtttgaaaaatcaggtgaagatttggttaatgatatctccccaagggcatcaagacctcaattaaaaggactgatttttaatgttctgtgctatttattatatcctctaacagagtatagactttatatagatgtttaattattaaaagaataaaaggcccaaatgtttagagtaatcacataccaataacgtggttgatcatttatttgcaacactggcataatcaaagaagctacgttggagtagagcaccttatgcaatgttgcagtaaaaccaacggcctgagaagccagacttgcattctggttctaacaccacaaccaattaactttgtggccttgggcaaaacatgatctctctggcttttggttacttctcagtaaaaattagagaactgaacaagatgctctgtcagggcccctccagctctgaaattctggattctaaggcatgttctcttatttctaactgcttcctccttatactttctaagatcccttgaagattatttaagtaatcttcaagtaagtgtgacagaacaaataccactaaacccaattctccacaacagtatgaagtatcctgtaactgggctactgctgagacctggaaattctgcactaacaaaaataccaaatgtcaacctggattaattttttcccgcattcagagttttggttcactgtgtcaccatatttccattattcttagacttagagccattgaacaaatctggttcctcaaaaaagagaagattttaggtctcttctttttctgatatgctggctaaatgaatcaattatggaaaataaggtcagagaagtgaaagggaagagggaggatacaaataattaaaatggtaagagtacttcacaaatagtatccctttaattctaaattattactactcctcttgtacaaatagaagaactgagattcaaaaagtcaaataacttacccaacattgcaaagtaatggcagtaaacggcaatttaaaatcaggtctacgtgactcaaaacctctgccattaccgctattccttctcctctgtgaaatttcctttgattcttccagttcaggtttatcttttgcttctccaaattccccttttacttacacccaccagaccaatgattagcttgtctcttaaattaactgtaaatgcaggttctctacatgtaatgtgttcatgcacttgtgttaatctttaaagacaatagtgtagtaggagtcaaaaaatattataaaatataaacttttacagaaatactgacaataagtattaacaaatactaacagaaatgccaatacttatattgaactacacttaaaaaggaaaaaagtttctataacattttaagcatttttctgaactgttaaacaaacaaaaaaaacttcttatgaatttcagccatccacttatggaaaagttgtcataaaatggctgaaattcccaagcaaaaggactggacatttgtgataaagaccaacgctaataaagcttatacatttatctttataaaaatgactaaagtattttagtcttggaaggtggtgtgtctgagtctatgcctttatatgatttttcttaaaatataacatcaaactcaaaagagaatttcacacccaaggttctgctttgtggattcttcagctggctctgtcaaggacctgtagagacagatgtattggactaatgaagtaatttgagccactaccttatctatttacaaagggcagagaaaattagaagacaagggtcctttgctgaaaatcacctgctatcttcttctgtaatttaaatgtagcagcaagaactgaaggctcttagctgcctgaggacacatgaggagacacttgtaaatcaaccactgaagagctctagatcagttcacaataacatctctcctttgtgcctggcaggaaatagaaagtgcttcaggcaggtgccaggtgtccccttcaggtattaaaaatttccatgcaatgccctagagtttcgaaaacactgaaaaacctaaggtaagtggcaaataagattaagagtgtatcttcaggcaaaacaaccagtttaaaagaaagactttcagaaaagcaaattatttcatagatatatccctaagtccctgaacaaagaaaagcctgtttgattaaattcaattatttgcatttttctacataattatcttagatcatacacatgagagacaaattttgatttaaaataatttataaaacttgatatatcatagttaatgtttctcttttttaaggcatattaaagacactcctcctcatacaattcaaatttgggcctggaaattcccacttcagcagaaaggacttctaatgctacccccacccccaatatgttacagtcatttcagaccctatgacttggctcaggatttaccttttaaaaatacagtctattttttaaattacaaaagtaatacatattaatactagaaatatggaaaataaaagtgtagaaagaagaaaataaaaaaaaatctattagcctcccagcttaatgaccatttgtatattggtgtggcgtcttacatttctttctttgcctctttatttttaaacattaaagtgatatactctttttaatatgctctattcacttcatctataatgagaattcccctatattatagaaaagcatggttttttatcttgtccttaatctttcattaagattcttatctaatatttaatcattcaacagattaatatttttgcaattaattcttttgttatattcaatgtgatatttgggttgagataaggatcataagtttttcattttccaaattgtgaaccaattctcccagtgttatttattacatgtatattcatttcccaaataatttatataacattatttttaacatatcagatttttatatattcttgaacacctctctggattttctgccctaggccatttttctcttaatatgccaatgctacatttttatgattattatgtgtttatgttataccattggttcattctgtactctatcatactcttttgaaaaatttctgattagtctaatagtctttataactaattaaaccagttcaaaaagttagaacttttattagtcatatcaatttttaaaattaattatgaaagacataacatagctacaatactaagcctccatttgctaacatagagtctgtttattcaaatcttctttaggaatccttaataaagatatgtcacttgcacatttatttttaagttaattcttcaatattttatgttttgtagctttataaaatgatttattttcattaactggtataatttataaatttctatttatttttaatactcaacgtttttctctcatttaaattctacacatcctagcaagcccagattaagtcctacctcttctacacaacacggaaaaatataaaatagcatgggttttgagaccagattaagattttaggctctgcctccaagtctctgaattcttcactcataaaataggaatttatgacctatgttgcatggctgctgtgaggattaaatgagacaatgtaaggcatctggcaccttatgtagtaaataaatgaacatcactatttgatatgtgaggctataaaatacttaaccttctataacatacaacactttttcaattatacaaatgaaagagattacaacagaaagttaaactcagtatatattcatatattcaattactaagcatgagaaaggtaatttagttctgtgattgagaccaaccaccctgcttccgatctgcctaggttcaaatctcaataccaccatttactagttatgagctttgagtaagccctttaacctcctatgcaccttatctgtaaaatggggataacaataatatctcccccatagggttgttgtcataattaaatgagttagtatatatattagacaattaaatgagttagtatatacattaggcagtcagaagagtgttgaaaagaataggcactacataagatgatattattattatctttattattatcattcactgagcttgtgtgatatactaagcagtgaggaggatacaatggtaaacaaaaactgacctactccttgctgtcacagagtgacactgggactacgatctgaaagataaatgggagtgaattaggtgggcaagggaagtagaggggagcacaggatgacagcagtggcaaaagcccattgatgggggcagcagaagagtacaaggagtgaggctcagccagtgaggcttagcaggggaagaaggagggaggcacaggtgaggcctgacgggggcagggccagattatggaacaatgcaaatgaccgggagtctatctgtcttctttctgtaaaagcagagggaagccatcaaaaggtaacataaccagatttccagttctaaaagagcactgagtcaagagaacagataggaaggaggaaagagtaaatggagtaggcagattgggaggtgattttatagttcagaaaggagcatacggtgtcatgggctaaggtggtgatgaaagtgaagaaatgtgattgcactagagacaaaacaggattaaaaacaacaggatttggatatgggcaccatagcaaagagtggtacccaagggtgacttctaggttctcggcttaagtatctggacagatgccagtgctgctcaattagatgggcaacagtgtctaggacagaaatagcatgtcctgccagccagataactgcacatttacctaatgcatggtcaacatagtgagtttgttcctgttatgacaggtcaggggaatcccactagcctgcacctcctaaaaattgtatactcacttgccactctgagaatgtaacctgccttatttgtaggatatgtccaagttcaaggttccaacactgcgttatcattatttttattacttacaatctccctaggttataaattccaacccaggaacagagaaagagatggcatcagaattgttttcaagaatgtgtcatcattcaacactgacttcaatcattctatttgcaagttactaatagtactctctcaggtattcccttttaaacaaaaagctgaatagtcaatgtgatgacctgctttaaatataaacatagaaaagtaaaacatttcccctttccattatctttttaagattttgtcaacaatgaagtattatcacgggaacacatgttataacaccttaaacctgtaattaatagaaatgcttatgttaaaataatctcatcctatctgctttttctaaaaaattttatttatttatttgtttattttgagacagggtctcactctgtcacccagactggagtgcagtggtgtgatcaaggctcactgtagccttgacctcctgggctcaggacatcatcctatttcagcctcccaagtagaatggaccatgggcatgagccaccacgaccagctaatttttaaattttttgtagagatggggtctcctcatatttcccaggctggttttaaactcctggcctcaagcaatcttcccatcttggcctctcagtgttggaattataggcatgagccactgcacccagccatatctgcttttttctaagctatcatgacctattagtgataataaaatcaatgtagttggtcacacacagcgtatttccaaaataaagaaaacatgtagaaatcaagttcattgcaaatagtaacaggaagtattgtttcttgagtctttatttcagttgagaggtgggtttgtatactgtattgccataaacaatatattattaatctggagtgaagtaaaaaaaaatttgaaactcattaacctagtccaattctagtattccacaaaggtgaaactgagacagaggaactgagtgatttttttccaggtctgataacctgtgaagaggcacagccaggaatagaaccctaatcacttaattccatgactcttgttttatatcatgtctcttttcagcttcattttctctcccattgtaattaagttctattgaggataactaaaacttaaggaaatcactgaatgagtttgcccatgaggaattaaaagcattgaaggaataatgaagtatgaaaataaatgaataacaagaaagtatgagtaatgggcaggttctctcttactccaaagggaaactatcagtgaaaaccaacaacaaagaaccacagcttttggttttgaaaaccaaaaaaatctaaacacaaacgattttataacagaaacttaaatttgtaaataaaggcccataagtgcctgaagtttatgatgcatatcctttaagtgaaaattttagggtgtctgtgtgtattattggaccacccaaatgaaaaatgaaaacaattcttgcctctgtacaatgcagtcaatcctctggatgactgactaggtctttcacttttcttcccaattttaggggtcacagcacaggcataggtatagtgccagtggctgattaaagcaggtcgcaatctgtctgggagagtttctgtgccattcttcatagggacagggaccagacaagatgacctcccttgctgccttccaattaattcaatcagcctctgcttctatcagacatcttcagggatgcaaactgtatactcgctccaagtcctcaccaggaatcagtaaacacagaggctgcagactgtgtttaatgaataagcaggattcatcttccagtcatcatttttatttacagcttgtttccaggtattattttctcccccaatgatctaaaatccctatggaagactggggccggatctaacttctctgagctcctgctggggctaatctggtacccaaatacatcttaggttaatatcaatgttgttaaaccaacctaacctgaatttctttctcaagaaggatgtataagtaagataatcccaattagctctccataaatctttttgctttaatattctgtgaagagccactctaggaaactattatgagatacagtaaagtacagtaaggaaaacattgtcaaacaaactaaatctataccttctatttctgaaggcatatatttagtgagccactgcacctagccctacctgcttttttctaagcttcatataggccatggcctattagtgataataaaatcaatgtggttggtcacaaacagtgtatttccaaaataaagaaaacatgtagaaatcaagttcattgcaaatagtaacaaattgaacactgcaaatgttcaaataaatatacataaaaggtagagttggtatggggtgtctgctttttgtttctcttcacatggactggcaggataatttccataatagaggaaatagatcatctgagactaactatattagacaatgttggtacaacagatccaagatgaggtaagtgctcacatgacagctcatttcaaacccctcataaatcaggaacctgtggctatatttcaacacttcctatacaatcaataaaacatcagtgttcattaggcagacctcatctatagcctcagatcaaaaactgtggcttttgactacaaacctaccttacaataagaagggagtgaatttaacacatctttcctttaaaagaaaataatctaatataaaatgtgatgtccttcaacattacatataagctaattatagcacatggtttgtgtgagctttagtgggctgcatcaggacctggaaaacattccaaaactgaagtggaattttggcccagtaagaactgaatcactaaggaacaaaccctggtttcaccttgagagataatgcatgacctattaaatctctcattattacccttgtgtacaaaaacaaaaaaaaattgaaaacagtttcatctttaaactttcaatgcatgcacatgcaaaaaaagaattaaaaatattttcatctttaaactttcgttgcatgctttgaatatcaaaacatattttgtgagaaaaattataaatagaaatttgataaatttagaaccaatgtgaaaatcatagcctgagatgcactttaaacttatttctaacaaatctgcttttctcagtgatttatttttgctccccaaattatggtactggcaccaaggacttggagagaaaacaggtatgataaagagaacatttaaacataatggcacaaatgtacacacgttcctaaatagccttcttcacagaagctgaaaggggaagacctaaccatttattgggatctattatgagcctaccaccatgctagacaagttggacagattgttacataatgcttgtaatcactctatgaggcaagtattattattaccgttttttaggaaaactgaagctcaggttaaataacctgcccattattatagatttagtaagtgataagccaagaatcccaactctgcctgtctattcaaagtgatctaactctttttattacagctcaggtctaaacaataaagaacatgcccacgtacagtgtaatgaatttagatgaagatataaacgtgttaccagatcctaggaaagaccagtttcaactaacactagtactgtaagcacatagtaaccatttggcctttgactttttatcacaagcttgcgttcagcttctatatgaggtgacttttccaggctggagtgtagtagctactcacaggcatgatcatagcacaccacagccgtggactcctgggctcaagcaatcctcttgcctcagcctctcaagtaactaagactataggtgaatgccactgtgcctggcttaatgtgtcattttctaatatgtgagttttctaatagtcttccaatacttttaggaacaagacagactcgggtattggagtaatctggtaaaacaccctctttcggtcaagctctttagaagagcctttatgcttctacttccttattgcaatgcacatcttggctgctgcaatttgacttctatcccaaccacacaccaatgctacctaggcagacaccattagttgtacttcataccaattcaccacttcttacatggtattagaacccacgatttttaggaaggcatgacttggtcagaataaagactttatttttccagcctcctttgcagccaaatttagctgctgccaataggatgtaggcaaatgtacagtatggtaatttttaggaacctttcttaaaagacccgggtcttttaagacccaggtctttcgcttctttatcctttttcatcctgttctccatcctgccacctaaatggcagatgaaatcactggagctctacctgtcacctggaaccaggaggaattagagccacaacgtggagatagcagagtaataaactagaaggagcctaggtcactacagcctgggtaaagcagtgccgctgcacccttcctgcaccacctcctctagattttaccagacacaaaaatgaggttttatctcatttaaacaaatgttatttccactctctgttacttttagctggacacaatcttatatgatatataactatgatctccttgtgtctaaacccaaggacactaaacatactccaccacattttgacttttaattttaccagtcttttgaggttttctggagcactaggaaaaccataaaatttataagagaaatctctcctcttataactctgttatctatggcaaataacaacctcttttgctttcactgtctccatctgttgtgaaagagagaataatgacctcctacttcaaagtgttgtaaggaatcaatcaaataaaaactacaatttctagttttcttgtgccccttttcacaggacacaagtcacttaagattcaaaatttttacatttgactttaaaatacctatttacctgagtacctcttttctagtttcacctactcaccaaattaacgaactttttaatgaaccaattactgtttacaaaataaacaaggaaaaaataaaagcctttaaaggtattctgttatttgttgtttctaaattcatcttgctttcctatctaattttaagacaattttgttaatggttcacaagggcagggatcatgtttattttcattcatcattttatttccagtgcacatggtaacatctcaaaaaatgtgagtgtcctctatcccaaccttctatgtctgccattcctgcagtgaggggtcatttccactgccatgttacaaaaagttataagtagatttatgtcctacctgtacaggccacctcatggcatccccttgtcctttatttttagtacaattctataacctatcatgttccttaataagaactagttgttctactctatattcttatactccaataatattataaattaataagacaaattcaaaagttctcaaaagttattatagttaccatgtatgaactttttgtccatcagctggatgtgccaatctaatttagaagatctgattaatctgacaaagcgtttctgaactgtatgactgttttactcttagttaagttcacagagttattttcagcatcatattgttttcattttgcaaatgtttttctgggtcacaatgctggctcttttctgcacccatgtgtagtacacatctaacctagtaatgagggaggctaaattagtctccagtgcttcttgcttttgcagttctagatcattatctcctctaaatagccatccttctttctccacatctctgcccaacaagtgcccaataccatcaaaagaaactgcttcacacagaaatattaatgactgataatgcccgggtgtgaccactctgagtgcattttgtcaacatgttatcacttctggaatttatgtcaccaacaagtttcatgtgtgtgacaatcaacaaatttagatggccatttatttcaactatcccaaagtcccctttctcagatttctgggagtcaacaaaaagaggggagggagtaataataattccaactaaatcctatagtgttacttttgttatcaaagtagcaaaggcctactttccttttgatactagtcatttgaaattaaatatgaaaactcatttacccttaaaacaacttgctatgtattactctattaatgaaaagtctttcttcaaaagtacaaatcttctattataaaatacatgtgaaaaatattattaaatcaattctttctcaacctatgagaaaacattctcaaacttcctcttttcctattatatttacaaagtattttctattctccttgatcacttttccaaatagcatcccattttatttatttatttgctgttatgtttctgttctttcttacttcttcataaccttctcttgccctgacttgctgtggtcgatatcttttttttatttctatttctggatattcaatatcatcttacatatttgtagatcatcatgcctcaatatgaaaattcattaactagggtaaattctactgaaatgtaatttttagttaatttcactaatattcagagaaattcctaaaactttccgtttgtgatccgtttcattctcttagacaaaaaatatcacctaaaaattaaatatatcacaaatggctaaaggggaaaatctccatctaattatttctatttgaaagtaccacattaaaaaatgcaactcctttattttcctcagtgaatctttgatgaaatccaacaaaaatgatgagttacctgaaaaatgtagatttctatcattaaaacaatctggccggtgcgatggctcatgcttgtaatcccagcactttgggaggccaaggagggaggattacctgaggtcaggattttgagaccagtctagccaacatgtcaaaaccccatctctaataaaaatacaaaaattagctgggcctggtggtgggcacctgtaaacccagctactcgagaggctgagacaggagaattgcttgaacccagcaagtgaaggttgcagtgagccgagagtataccactgcactttagcctgggtatcagagcaagactccatctcaaaaaaaaaaaaaaccctttcagatatctttaacatttatgccttgttcactcaaaattgtatgtgctttttaacacctcccatcctacttatactacatcttctttatattttctttttttcagagtcactcaaatatctcctatgccctagaatgtgattcttcccccatcttttgaaatggtaaaataaaatacaattgtgttaaatgacatgaagaatgaattctgtttcctctacaaatggactctatcataactttatagttgaacatacaattagcagcaaaccacgagagcgtttaattagacctagactctaggagttgagttcacagattgtgcctatgagaaagcaattagaggtagatctggtcagttaaaaaaaaaaaaacctcagagacagaaaaaaaaaaaggtccattgttttgtcttcagctgatgtaaattcagccttaatgaaagataagctattttcacagagaatagatttttcatattgctcagagtgtatttgaaatcttataacatatggcattctaactttgatatgactttttctgagctacctctatattatcaaggaagagaaaggagaaatagagcaaatagcaaagaccatatcaaacatatcacaaatgactatagacaggaaagcaagatggtttttcttagcatagacttaatttgtctacagtatgatacataacatgcaataagataatcactataaacatcttatgtatattacacttattttgcatttcctgcttgccagaagccatactgaaatccaagatacactaataatgttcaaaagactaaccaaaaaaaaacacacaatgaagcacaatacagagtaattactattctgtggaaagaacaacaaaggcatttttttttcctgtagctgtaatcagtttataattatggcccagcaaacaaggcaacacataaagaaacagtaagaaactcctcctcagcttccatgttataaatttatggtatcttaaagctttttatctttgctgccccgacagacgacagggactccacaattcttaggtgactgttgccttcatcagtaccagcatccataggtacaggttaatgttccacagccgctaatttatttttttaaatgttaaaaccccatagagcatgacaaataacacaggtttaaaatataaacatctaaaactcagcaacaggagaaagtagcttcttatttgccagtgacaaataacaagcctgcagaaatacgaaaaatgctctccaaaaaatatatggatattatctgataatggtgacttggtaaaaattatttcattctagtaaaatagaaagtgcaagttgctttttgctactccatccatttatgttttccattaagttcctttctatagaaggtttgctatataagttatgtcgtatattctcaggtatagatatatctggaaaaggagaacaacaaagactctcttaattttttcagagttgaatccctaaactgttttccaactggcatgttgtactatgaaatccaactattttatttgcttaattccagaactggtctctatgtgagaacacattctctctctcttttttttttttggacagagtttcgctcttgtcgcccaggctggagtgcaatggcacaatctcggctcactgcaacctctgccccacaggttcaaatgattctcctgcctcagcctcctgaggagctgggattacaggcgtgcaccacaatgctcagctaatttttgtatttttagtagaaacagggtttcaccatgttgcccaggctggtctcaaagttctgggctcaagtggtccacccgcctcagcctcccgaagtgctggaattacaggcatgagccaccacaagtggccaagaacacattcttaatgacattgttaaagatattctgctttttaaaaaatgcataatactagcataagtttgtattgcaattttctgtcatttgataaatatagagataactctactgcccaagaagtttaccttcatgtagcttcataaagatgcaatagataatacacccatccacaccaacattttaaattaaatgtcaggaattttgttttgtatttgtaattattcatgtcactgcattagccattgtattagcattttatttaaaagtttactttttttcattaaggattatgattgtaagtcctagaggtgaatccgctttgttttcttacggtcgtgccaaggcagtcagagggtgaagaagtttttgccaagtcagagaccagccctggagccagggctgcacttatgatagcaggaacatatgataaaatcaatccagagtccaaacaagtgaaggtgaatgaggaagggcagcagcgatgctccgtaaagtgtggatgcagacagtaatgcctggtgactgggtcggtgagaatccagggctctgggtaggatgacttggcatgaatgtcagaaggtgccaactgctctactagactgaagaatgggagtcagatgtctttcctgcggggcagttggtaggaaatttcagatcctcattaactctttgataccaccagggggccatttgataaatgacagtgccagtgttctaaatggagtctaagcatctgttggaataaatgtacatcctaaagtgcctagcttatgaatagagtgtcactcccacccagacaatgtgcaataatgacttgtacatctcatacatgcagttattacaccagggagagagacagggacctattcaggcatagcacacagttcttaagaatattacattactacatttttttaaaaaacacttaatttgagatgtcatgcttagataattgatatatcttctcttgctactagcattctttgcctttattttgtgacttgctttcacaacacagaccttctttcagagttactataatctttctaccttctgcactattttcatattttaaatgcaaagcattgtctacattgtcttatatgaggcagctttcccagactggattttctgtaaagtcctgctgtaaccaggtaggctgccaacttgaggtagtgactcacactctgggttctgcacacattcaaccacagagtagagaaggaggcattctctctttcccttgcttaggaaatctgaaggggaaactgacttgtaatgtctattgcaagtgcaacaggactgtgttcaaaagcataggccttaaatgatctttcaaagtaatttgctcatagtcattattttgttgccatcaggtgaagaaatagctcttggtcacagcttgtgggtaaaagaaccatagaggtggttaactggattccattttttaaaaatgcaaccctaaaacagataaacatcaattttaatcaggctattaatctctatactgaaactggacatgtacttgcagtgaaacaggtttctcggaaagatggagaaatggagacagatacaccaaacaggcacacctgagcactctgtgttcctcagtgagaacgtgggcttactgatgctgagtttgcttctgaaatcaggagtgcctggtatttggaaacatcctttcaatggaaggtcacagattataagtgatatggtttcagagtggtgattttaaatgcttgtggtacatgcaaaatgctgctgttatcccagtacctggagagcaaggcccatggtcccaggatgcccctcagcaaaaaatgctagaagaggtcagcaagaggatctgagcttgctccagtcctgggtggcctctccatatctggtcactctttgtattcttgatggatatttaaaagaacatcacggtgaatgcttgtgctctcttttaaccaatagctattgctcctggaaacctaaagtaatcaaagcagtatttaaaccaaaagttagcaatgtgtggtctctgtactagcaacagcagcatcaccttgtcaggaaacttattagaaaagtaaattctccagtctctccccagccctgcttaagtagaacctcttggctagggcccaacagtctatactcttaacaaagtgattctgatttctcctaaagtttgagggcccactggcttaaactgtaagcaattaggtactgttactctaaattactctcagctttaatcatgaattaatctgaacttggttgtctcccctgacttcactaccacagccctgcaattcaagcagtttcaatctgcaacacatctacagttccagaaaataaagccattgtttttccaatgaaagagaaaaaggcctctgtgtaggttacggggtgctttttttccatcccaggcatgaatagtgtattcactttgtcgaagctgtttctgtgactatgggaaacagaagtagctgcactttctaacagttttgaacacttgcaaaccatcagtatggtgactggccacagcaggatcccatttcttctttggctccttctgcactgcccctcggctacaaaagatacatgttccttcaacattctttcattttctccttctctactgaagtccactgtaaagattgtacatcagattcttccctgcaatacaacttaaactgcagaacactcttttatgtttgtgctaagcccctgtaccttcttttccctgccagaaacagaaaagagttggaagaatgtgttgaacatgatcatgctgcttgaagatttttcatgagttttcctatcagcttgtttacaaatctttacttcattatgtgtcttctttttctacttgtgataaagtctcctctttttctacctcctttctgatcaatactttaaaaaaattaagtaatcattgccgtgtgaaccaatatctaccaattgcattttattgttttgcttagttcggtttgctgtaataagagaaggttatgatagagtggaaagggcactgcggtcagaaggtccacatttaaggaaaaattccagcacttccagacttatcagcacaggccacttaaaattcaaagctggagtcccctgatttgaaaagtgggattcatgattactcctgccctgcagaccccacacaactcctgagaggaccaaattttaaaaatgcatgtgaagtcattgtgaaaactgtaaagagttatataaacctgatttcctagtttctctgcgaggatttactagactcaaagttaacaaaacaaacagaactaggacttgaaagcaatcacaagtctccttagaataatagtagccttttaacctatagagtcacaatgccacaaagaatttagacaggttgatccaattgagtagctagtaaatgtttgtaataacaagcaaatagtaattgttcagttttgctaaagcagagaaacttagaaaatatatcctaagttatttccatatttgaaggaaattggaacaaaaggagtaaatacaccaaagactacactaactaaaagaaccatgtgaggtcaatgatggcatatggaaatgtctactaatataaaatgggctttgtggttaatcaataatgccttaatagattatgggaaataatcacaccagtaaggaattactctggatcattaatagcagtagagatttccatcaatttaaatggcccttgaaaataacacataatatttacttgcctgggttttctttaagaaaaatatcgatttgaaactcagaaatcacaaaaacaaagaggctaaaatcagacagaatgtctttgctctattactgaaaccacataaaaaataaaataaaaaaaaaagcccttagcactagcagtgtcaattatccacattatttatcctgatatacaatcttgaaaaaaatctgcctattaaccttgtggaatgcattctcacagccattttgctcagcaggagcttacaaccagtcctaaattgttagtggcaattcccaggtttagtgtctccaaaggtaattttctccagttaccaaagattagagtcctcagaaaaatggggtccttaaagttaacatactgtcatcacagacccattttccaattcagaagataaatgtattttatttgctacctaagaaatgatagcaaacaacaggacacaattcatattgatttttcttccgaaaaacatcttcctaatcaatatcatttattctaatatataaaaatagtgttcatacttaaccagtgcattatgctgtaccctggtattttattattctgagttttaaaaaataacaagaccacaacactaatttaaaaataaaagaaatagcagtgcttgttaatatgccctaaaacggtgtttgtcaaagtgtggtggttcacacacctgtaactagaattaaccaggatgcttgttaacgttctgtaactccatcttagtgaattaactggaggggaatttggaaattgcattttcacaaagatttctggtgattcctgcgcacactacagtttgtgaaacactgccaagctagccagtggttcccaagtcggctgtacattatactcacctggaaaatttataaaaacaccaatggtcagacctcagcccagagcaattaagccagaatctatcggccatgggcagtgttgccaaataaaatacagaaggtatttctttaacatgcttatagtaacaaaataattcttgtttatctgaaatttaaatctaactaaacatcccatgttcttatttattacatttggcagcccaagttataaagctcaggcacagcaagatttttaaaaagctttcctttttgagtcaactggacagttgagattgaaaacaactgatactaaacctaggctctaaagatatcgaaagatatgactatacacaaactctcaggcattaggcgcagagttgaaacaatctagctcagaagcaaagtgaagtacccatcacagctccactatctcatatactcatttgttttccccaaaattttacaggtgttgactgatttttaggtaagtttataataaatgaaaagtatcaacataagactcatctttttaaaataaaacatcatttttaggaaatacttagaaaatactaaataaaatgagagtttccaaaaagttggtgtccatgatcagctaaattcttttataattggaaaattggcttctacagtcacaaatccctctttttggatcaccagaattcccattaggagaggagtcatgagtaacaaccacctctctcaatgccattcagtctgccttgaagcgttcacctggcagcagaaaattaacagcatttcctccttgcgaaaaagttaggagcctttagacattatccaattgtccaatgaatggggatccatgtggataaacgcaggcacaaaatcatccacagttttacacagtaagggagaagattaagtttactggatgtatgttgctgcagccagtgaagttagaataaaataagactggaaaaaaaaaaagcccaaaatttttggaaaggcagagtttccccattatggtcaccccacatttaaaacatcaacatagtctacacataaaaataatttacaataaaataaaacatcaatatatgaaccttaaaataacattttctcaagaagaatttcagcttctaattttccttaatatacatgagttaagattttaaagatgaaatttaaacaaagctgaattctaatcagataactgatttcaggagttactaaataaattttaacaagaatatatcttcataacgtacctttgtaaatgaagaaagaacacaaattaattaatatgagaaaagtacacgcccatttaagccttttttatataatttatctctgttgtccatgatttcagatttcctgaaatttccttaaaaggtatattcccagtatcacatcaacatatcatatcatatcaaacacttagccatcatcttgcttctgaaaaaaaagtgaaattctaaaactaccttgatatctattagcatatagctctagattttgatgataattaatccacttctttaaaatgtggtgtttaccaaagagggaaacataaatgaccagtggatgacttaaatgaccttcactgagttaacatggcactcctaatgaccatttgtcatggctcctggcaaactatttctcactaatataatgataggggagtggctcataggaacctggtgatttagtgtttacacactaaatccctttaaattaaaaataaactaagcacaagatgccacctcatttgaggttcacagtgtgcccattcctccctttttggtctaggagaacactagccctctgtgaatgcatgacatagactcctctggctaagatcctctagttaaagcaccctccaaaaagaagagccctcctctcatggatattatattcattattagcaaataaatatcattattcccagaaacaattttggaggacccactggggcttgtctcaattctaggcattataaaattcagtcctacactgagctcatcatcttatctctctttaggataaataaatgtgggttgcgagatttaataaataaatatacacgatgcccagttaaattcaaatttcaggatcagaagtgcgctgttctctccttttgaatgggagagtctaattggacattttacaattataatccatttactgaaaataaaaataaaagttcaaactgaactctagactacagaaatggtcattaaatgtgaaagcttcctatccccaccctatgagttattatcagacttgcagttcattaattcttgagatattcatggcttataattatcctagcttttctgtcaatataaaggttacaacttaataagagttaccacgctaaacctcttaatttttataaatacttcatctgtgttgtgaatagcattagtaaaagtggcttaaactgaatggcctaagaacatcatttgtggtttatcatctattatttacatttttaacatttaatctggaattacaagcaaaatagcatatattcttgttattttttaaaatattaaatcaccaataacatttccaactctattttttttaaaaaatcatattttggatttctctaaataccatgccatgctccatggtccatgaatatattcattaggactgcagccagcagtgtgcaaatttatcaataactctcaagtaacagaagtgaaaggctgctccaatttgaagtctactgacaattctctgaagccaaaaccttttagtctatcaagcatggatttattcatgatttttgaccttaaaaactttagggggagagtgttgaaaaatttaaaggtctaatcattgtataaaaactactcttagaacatgaaatactattctaaaatctgtacctaggactaagattgtgtaaaacaacaaaggaactcaaaattgactgctctctctcttctccctcatagcaacatgaacttttgtctggctcaagcccaatactatctaaagatatattttgatgttcccattaaaagtaagatggagacaacaaatattgaactgatagtatttgaaaaatgatttgagattgtcttatttggggataagtttacaaccccaggaaaactgcaagaagagaacgcctctaagagaagggccaaatgacatcaagatgctctgaattctgcactaaagaaagtctcagaattctttcccatatttacacgttgccaagtccagtgtcttcaacttgtcttccattatattgggattaataccttagagcattttttttttccattgtgtagtgtgcattaccttcataggggcaaagagaatgccccaaagcagattcaaagtgtataactcaggattaagaaaaaaggcttcaacgtttgcattttaccaagatagaacaaagacatcaaggagagtcctgatgggcaaaaattacagatccagatgaaatagtccagaagtctaaggcaaagaaaaactaggtaaaaatacaaatatttttctttacatttagagaagggaggaagacatggccatggccacctcatagtgataggggtgcttcaacatgtccttaaggccacacccaggatcattctgaatcatcagcacatatctgagataatgacagggatgggccagtgagagcatcctgtgcatccagtgggatagtaaagagagtttcagcttttgaaatagggctgagctgtctccatgtcagccttggctcttgcctagtagcgggcctttgtagaaaatcaaaagggaaaatgggacagtttccttcaacaagacgttttactaaactaaacttctcatacgtccaagagtgaagttctgggacttgctgctcctgacacatcactgaggacagatgactggcatttgcacaggaggtcagagagcaggaaccattagagggctggggctgttggaaaaagccttacctatgagatgagactgggaaagtctcccaagaagtgtctgtgttcaacgaatgtggatcagaaagaacaacagtgataataacttggagcaaaagttccaaggcagaacctaggtagcactattggagaacactccagagcctggtttgactgcctcagagacattatataaggagcttggagaagtcatttggggagttgaaaatgggccaaagacatagagggactaaaatgccatagtaactagtgtagacactctcatctcttgctgcccgaagtgtgatctatggaccagcagcatcaacatcatctgggaaaagatagaaatgcagattctcagggcccactccaacctcttgaatcagattctgcattttgacaagatccccataggattcttgaacacactgataattggagaagtaccactccagcatttagtggaaacacctggtactaaaactgaaggcacgctcaggaatctccattttcaacaaacatcccacgtgagacaaataagaagatggcaaataccaatcagtagtgaggagcatgttggtctgatgaagattagtaggatggatgtaagagacaagcagcaatcatttaaaatacactaacaataatgtagacatgatgatatttatgagtaaggtcagacaaccgattttaaacaacctctttgattctcagcttggcacacaggaacacaggatagattaagtatcaagaatccctccttgtacctagaaaattcattccaaagatagtacctccattccttcttcctccatccctggactgtagaaagcagattccccagctggggcactcagctattagtaaccgaagtactgctcatagagtacaagaaatagtggctgaagtgtggcaggcattctataaatgtggttcatgttgttgctataataacagcaattattactaatacctttgctatgcctcctcacctgtccagtttgctccctctaagttgggtttacttagctcattgagacttctaagaacctggatgagacaggcctggatttgaggcaaatcagcacaaaacttcagaatccagtaatctcctccttctcatcccaaggagactgaagccaggaaaaggagctgatgagttccaattaccttttcagaagatagttagaataggaataatcaacttactttacaaaatcagaaagtgtatacatcctcttttttcaagtatgatgacatggttatcctccaacacaagctctaactttcaagttttttttaaaatgacaatgatattaataatgatgaatgctgatgaaaatattctaccttgccaaattactttgtggttccttaaaaaccacaagctctacgaatctcatcatatcctaatgcattgctttgtacagacccaggaaggagaccagcctctatcattcatcaaagtgtccttcctaatgcagtctacgctcccttcagaagtccatctgcacacccatcaggcttccttctcactcctgtactatgaaagtgctgccttcagtagactttccccccatttttcccatttaaatatttataactgtaatgcagccatgccctagttcatcaatagtgattcttcttatattcaatgaaaaagaaatgtagaacattagtgagttagaggttggtctctcttgctacacgctaatttgtttctttgaccagcctctgagcttgcagctcacatcatcccaactgtgccacttggagggcatgaagtttcaaagaatatccagccctctaggatcctttatgtggtatcccagccaataatttggggagaaaaagtgttcaatccttttctcaaatgtacaccaaaataaattctagattaattaacgtttaaaataaagtgtttaaaagaaaatagagcgctaatatttccctgccttgagaaagacttttaaggaataatattagtcagaagccttaaaaagaatgattaatatgtttaactgaataaaaatataaaacttgtaaaatatttttaaagccatgtattattagtactattaaaaagcaaataaatatcttgaataaatatttgtaatatctgatgaataaacatgtaatattgtatatggaaaaagctgcttaaaataaataagaaaaatgagaaatatttgaaataaatttttaaaatctaaatggccaagcttataaataggatattcaaaaaagaggaaacacaatcaaccaatatgcatacgaaaagtgttaacctcccttgtatcaaacaaatacaaatcaaagccatgctataacacctatttttcacctactaatgtcctatatactgctagtgatagtataagttgattcccattctctagataaccatttgccaacatttaaaaaaactttaaaaatgtgtatatgcttcatgccgcaatgccacttgtagaaacatatcttaattaggggtagaggtgacgtctattaaagcaaccaacaataatgaacatgtatataatggaatgctttgtgaccataaaaatttatgatctagatctataattattaacttaaaggttgttgttgatatattgctatatcagaaacaacaagtttaatgaatagtatttttcttataatttattttgggtaaaatgaaaatgatgatatgcttatgtttgcagagggcaccaaaatagtattactatgtggctggtatttaatagcttattaattaaatattttcttttctgtattatataattttctataatacgtatgtattagttattgtaatgcatgttggttaaaaataaaaatatgtaaatatttacaatgcagaggggagggagagggagagagtcagcaaacaaaatattcggaaggggtcccctctcatagtaagaaggtaagtagagagggctcaccctttcagagcgactagttgcagagggaagagaggccatagtgggttgtctgtctcctttgcttcgagtcagattttattgctttgtacactttctcaactatacaaggaactattaataaaaagagttaaacatcaacattgctcacattggactgccagcaagtgagttgcctaatggtttatttaactaacataagtaatgtgtcactatattactgatgcaatattctgaagaacagtgatagctctacgtttcccttgttatgttagaagcactttttaaaattagcaaataaaaactatatatttatggtgtacaaaatgatgttttggtatttcatacattgtggaatggctaaatgaagctatttcacacatgcgttacctcacatatgtatgtcttttttgtggttagaacacttaaaatatgctctattctcttggcaattttctagtatacaatatatggcttctaactgtagtcagggtgatgtactatagatgttttgaacttacttctccatatctaactttgtatcctttggctaatatgttcccaatctcccttctcccagactctggtaatcactattctaacttcctgcttctatgaactcaactttttaagattccacataaaagtgagattgttcagtatttgtctttctgtgcctggcttattttactaacctaagtgttcatcaatggatgaatggataaagaaaacgtggcatatatacacaagggaatgatattcagccttaaaaaaaaaggagctcctgtcatttgaaataacatagttgagcctgaagggcattttgataagtggaataagttagaagaacttttgagtgaaccccacacctgtgatttttctggccagcctcttcgtttggccttccagaatactccatcagaacacattatcctaaccatgcctattttccttaagagctgcagcataaatggcagaatcactagaagccatgccacaaactggaataaaaccacaaaattaaagttttaaattaggaaagaaaaatcttcatcctttggaagcacaaaggtcaaaatgcactgagaatatcatggagacaatgaccacttggttcaaggaaatggtgttcattcacataatcacagcatcatataaataagctaatagactgtgggccacaaacctggtgaacaggcataaatgtacaggtcgttcttagcaggatttactgaccttgaaagtgagatggaggctgatttaacagaggcaggtcaaagagatcagtttccaaatagtcacttatctattcgtaaatgaaaatcatctttgaataaattagtgattctcttggtgcctgtgaggccccaaattattctggcttttcattgtaaatgttttgggtgtcatgatttcatttccctttaaaacacatcctttactagtaaggactttggaaccttgtgtctgaagttcagagaagctaccagcaggtggcaatattggtttattgagtaacatcacaggtatgtgtgggcacagactgcgggtagctccatggatactctccctaagatgtctagtttaattctttcaaaatacaaaactacttacacagcctccagcacttagttgagaggagggaactctaatcataaacgtatatacttatatagaaaggtaatgagaagcaaggttctcttttcaaatataaatcaaagtcaaaaaaaattataggtagtttgagtctcatggttagctgtcttattatcaatgttttcataaattctataatcagagcttacattcttccacatcctcagagatgatctttgcctttcttccagtcctgcacattctagttattgtgagatttaagcattgttctatgactccacaaaccaagtaaacaaagtccttaattatctctaagcaagggtgctgactacaatggtcaagaactccagccccagtatcaaacagccatgaatttaagttgttcaccacttacttgggcagagtatttattctcgttaaacctaactgtcttgctctataacatagtgttaaggatacacctgcctcataggattaaatgagagatcatgtgtttaaagtgctaagtttaaggcagtatgcctggcacatagtaaatcgtcactaatactattatcatgacttaatgcaagtccctgactgattgagtaccttttcttttgttttaatggtcagattttaaaaatggaatagttaacttaccattgcttgtacactaatcacaaaagatgcagaagggtaattatcaaagggatgcactctctcttctaaaactgatttcaatctcctctcctaactgtcctctcagtctgcacttttgcaattacagctcttatcaatgttgtattccattggcctgattcaccagccccttggctttccctgcagctgtctggcagcttagcttttttcccttatctctactactttaaggaaagctcttacttagcaggatcacttcttttcgttatctttccaaatattccaaacataaccaagatatactgaaatgactgcacacaatcattttattttctacaaatcccctccaactctatcccgcttcattgtctcattcctttgtttattcttctgccataattggccaggtcaggcagccagttgaagtaaacattttgccattaacctattgaccgcagaactttctgtgtgaaaaacctggcttgagagctccctcctctcctgtctcttctctgcatccttctccctgcttccacctttatctaacagatgcagcttaaagaaaatctagttataattccacttcaagatccattcaacgaagacacctgcattttatcctcattaaggatgtgctacaagctgaaaacattacagcctgaactacaaatagtgcccctttctttacggctgattacagcaacttggttgtggtagttggtatgcctctgtatgtttataacaaaggatatgagatggaattaactacatctagcttctgttatgacttactctacctatgctgaggcttgttaataatttgtaggactttcagaatcttaaccaactctatcttgctctgctagaaactattctaccagaaactgcaccctcccctccaaataaataaatcaacagcagggtgaaatttcttgcccagactgtggtcctcttaccactcaatattctccatgaacctattctgacactttccttccatctgagatgctgagtataccaatcccaatggtcagcccataaatagtaatagaactctaactcatgatccctataataatacgcctagaaagccaaaccgtaactcctaaagaaattggctcagaaaggtcaggacttgaccttcttaatgactgtcagcttccctattttttgtctccactctgctttcaacttgggaccaatccaaaaaagccaaaaatgatcccccaaacccatcacataagatgccccacctctggttagcctaccttcagcttccccatggcaataatgtccaatcagagcacaactggaactatttaacatgtatgtatttgttgaacaaagcttccgcatccccctgcctgtcttggaattaggcaagtgatggtggctgattcccttgctgtagcaagctgtgtgtgaatacctccacttattctgctttgaatagtctttgttattcccccagtattactagaggttccactgagacatggtctgcaccacccactgtttctgtccctaggtttcaatcaggtgcagtacccatggatacctcttacagcttgctgcttgtggcttgcatccatgcagatgtggaaagtcagcatgaggtctgaactcagctatcttttcactgagtcccttggctgtttattctgtttggtacccaagttttgttattgtctcccatttgtttgacatccttggcaggcctttcctactcaccctctttgctttatttcattcttctgtgtcggactgtctgaaagcgtttatcattagaatgagaatcccagggtagagcacaggcatgagtcctataagcctatagtttgagctggtctcacagactttcggttctctccagaccagtttccatttgtacaaactttgctgtgagtcaccaacaaaactggacgaggtcttttttctattctattttgtttttggggtcctgaagttttgctttgattcagacaagagttttgtccctgatgttcagcctactgtgtccagaattggtgggttcttggtcttgctgacttcaagaacgaagtcgcagaccctcgtggtgagtgttaaagttcttaaagatggtgcacccggagtttgttccttcagatgttcagatgtgtccagagtttattccttccggtgggttcgtggtctcgctgacttcaggagtgaagctgcagaccttcccggtgagtgctacagctcttaaaggcggcgcatctggagttgttccttccttccagtgggttcgtggtctcgcggccttcaggagtgaagctgcagacctttgccatgagtgttacagctcagaaagctggcacggacacagagtgagcagcaggaagatttattgcaaagagcgaaagaacaaaacctccaaagtccagaagaggacccgagtgcattgtggctgcttgcgcagctggcctgcttttattcccctatctggccccacccacatcctgctgattggtccattttacagagagctgattggtccgttttgacagagtgctgattggtgcatttacaaacctttggctagacacagagtgctgattggtacgtttacaatcctttagctaaacagaaaagttctccaagtccccacccatcccagaaacccagccggcttcacctgtcactggcatgcgtcgcgggactttgcggcacctagccagccactctggcagcccagagggagctcgccccccagtcaagcccagcaggtgcctgccggctgtgccgctgagtgcggggcttgcggagcccgcgcctacccggaaccgcgccggtggccacccgtaagccccagctcccacccgcgcgtctccctccacacctccccgcgagcagagggagccggctctggcctcggccagccccagagaggggcccccacagctcagcggtgggctgaagggctcctcgagcgcggccagagcggacgccgaggccaacaaggaaccgagagtgagcgagggctgctagcatgttgtcacctctcactaccaggggatatacattgtcaggtctgcatttataggcagctgacttgttgaggacctgagacatgaagtacacaagcattacttttgactaagttttggcaggtctcatgaggttaagactaggtcttctcctccaagaaaaacttctgcttcttttatgtactgtcattgcagtcgtaactcttgagcatagctctctaaatggcacaagttcacaaaaaaaaatattgagaccaaaggctacttcgacttgaaaaaaaatgttcatttgagaggtgccttaggaaaaaaaaggaataagatttctcaggcctaaggagcagcgtttttctcttgtgcagaggtctccaaatgaaattctgatttcttcactaaaacttcttcactaaaagatgctttggtctaggctaaccctcggtttgacaaacttaaaaatcaagcgagatgcatttccctagtaaatccctgttttcctagtccttcagttgcctccttatatccaggtttcccttttgcctcttcccccttcattatattatctctcctgccactcttccatcatctcctcccttcacttctccttgtctggactccctacattttccaaatgattctcctaaaaccctaaaatcccagttgcctctaaagacccatccgtcctagtcccaagtggtcccaggcatgtaggcaattctagaatttaggcctcagatctgagctgaattaaaagctataattaaggattttcctaactccacacaagactagcacgtactcatggaataatttagactattttgagtgcctacaacccatagatacttgacctatgacaacttaaatgtatgttggttggaacctcagacactaaatcctaaatgacaaaaatggaccggaatgactcaaaaaggagacctagatgatccctctttccacaataaacctcagggtagaaaaaaatatcctagtcctgaaacagctacagtaaaaatagattgggctataattcaatcatgcaaacagagaaaacatgacactataggatatttgtcaatggattacatgtgaaattggagactcaatttagaaacagaaattagcataagaagtagactcttttacctgagttacaatatcatacagaacatttttaaagggcttcagaacccaaacaagacaagacccaaaataaacttaagagacctgcagatcaaacagctaggtagctcactttctgacccatcacctaccgaaaaggatacttgcaagtattaaaaacagaagagacactggaaaaaaggattgtcccatcatgcaaaataaacaccaagtcaaagaaaaatctctcaattcagatctgtgagggtaatctgaagaaagaaaaagcacccaatatcctaccttactgtaaacactcaagatgaattaactgtaatatagatggtcaacctgctggcaggtacaagagctactctgtcttcattacaccctgttacctttgttcagcctcttccttagagcaaacatacaacataggtggtaggtttttcaaataatgcacagattgttcctatatctcaatctttaactgtaatccttgggctcttgagtaaaaaacattccttccttctctgtgataaaatccctgaaattttaataggaagtgacttactttgcaaattaaactgtagtatgaaatgcaaaccagaagaactatttcttgaggttccagagtcctcctctattcattatcaaattgtgtctgctctggtatgtctttgcctcctccattacatttgatgcctaccacagataaagctcctgatatatggattagtttcctattgaagctgtaacaaattaccacaaacatagtggcttaaaacaacacatatttattattttacagttctgtaggtcataagtgcaaaatgggtctaactgggctaaaatcaagagtcaccagagttgcattagtcctagaatctcacagggagaatctgttcccttgcgtattttatcttttaaaagccacctaaattccatggctcatggcctcttcctccactttcaaaagaagcagtggggcatcttgaaatctctctaacacaagccttcttcttctacttataaggaccactgtgattatattgggcccacctggataatgtaaaagtcaactaattagcaatcttaattccatctacaaactgaacccccttgacatataggatgacatagtttctggtcagtaggaggtgaacatctttgaggggctattattctgcttaccacaacattttacctgacattgcatgggctaaaatttctgctgatataggaaaaataattagagggaaatctattaaacttcagacagattctaccagacagttatccaaactcccccaatatccaaaagcaaaggaaggacttaaacctatagataaaagccttatatcaaagaccttcccatactctacactagcctttgtaacactcccgttctgccagtaaagaaaccaaagaagtgagaatattgatttgttcaagacctcagggccatccacaaaattattatccttaatttccccatagaatgtaacctaactaccatcctctcatcaattccaaatgccagccacttgctgcactgggacagatctctgctctgcccttttcagagtgtctgtagtgaagtcaatgcctttataccttcacctggggagtgcaacaatatactctgacagtcatgccttaggggttcactaaagaccctcctattttcctagattctcaaataagacttaaaagacataggtttcccttctgattcagttttgatacagtatgtagataatctcttactttgttcacaggacaacaaagcctgtaagaggaattccacttactctcagtcttagcagaaaaggacataacatttcaaaaaataaattacaattatgtcaaaatagagtcaattatttagggtatgacctatgtataaaggggaaaacatactctcattataaagacaattcaacttgtcctggccctctaataaatgacaacttagagaaattctaagtttaattgatactgaagataatgagtgccaaacttttctgggattgcaacatctctttatgaattgactagggcttcaataaaagatactctcctctaagaggaaaaacatgaacagggcttctgtaatccaaagaaggctctttaagagcctcaccttctctaagtacccttaactacaaaaagctcttttatctatttgtgcatgagtaatctggacaggttgaggtttaaactcaaattcaagagaagcatcagaaacacactgcttactataactgcacccatgacccggttgcacagacttagcctccttgtctcaggacaatagccactgctgcaaaaattgtcaatgcttctgctgaattagttcttagctccccacttgacttcatggttccttacacagtacagacattactactgactaagagcaaacaatgcttttcagccagttggttaacctcttatgagactctgttactgtctccctcccacattactaaaattcaccactacagtaccctaagtcctcccactctcctgctcctaccaaaagaagggaaactttacaattatcttacctaagtgaaggaactttatgtacctcactcagatttgttagagattcccattggaaactctcacctaatatgatttgttggcggatgtctcaaaacagaaacttgaggttatcaaacaggatatgttatccctcactaatttaaggtctcctttagagtacacttggccctccacatctgtaggctcctcaaccaagaattccaccaaccacagatagaaaatattcaggagagttttccctaggttttcttcaagtattgttatagtatcaggtctcacatttaagtctttaacccatcttgagttgatatttgtatatggtgagagatagaggcccagtttcattcttctgcgtatggctatccaattttcccagcatcatttatggaaaagcgtgttcattcccaatgtatgttcttgtagactttgtcaaagattgattggctgtaagtatgtggctttatttctggctactctattctgttcattgatctatatgtctgtttttatactggtaccatgccgttttggttactatagctttgtagtataatttgaattcaggtaatgtgatacctcctgctttgttctttttgcttgctttgggtattcgggattttttttttctttggtttcatacaggttttaggattttttttctaatttcatgaaaaaagacactggtattttggtaggaagtgcattgaatatatagttttgggtagtatggtcattttaatgacattaattcttctgaatcatgagaataggatgttgttccattttttaatgtcatctacaatttattcattagtgttttgtagttttccttgtagacatcgttcacttccttggttaaatatattcctaggtattttgaggttttctgtggctataataaatggggttaccttcttgatttgattctcagctagatgattattggtgtatacaaagtttacttatttttatttgttgattttgtaccctgaaactttactggattcatttatcaaatctagttttttggtagagtcttcagggttttctagatgtaagattatatcatcagtgaatagggataatttggcatccttttttttccagtttgaatgtcttttctttcttcttgcctaattgctgtggctaggacctccagtactatattgaataggagtggtgaaagtgggcatatttgtattgttccagttcttagaagaaatgataggcaacgaagattttgaagggtggaggggtgagaggggtgaagatgaaaagttacttaataggtacaatatgcattattctggtgaaggatacactaaaaaccctgagttcgccactatgcaatatatccatgtaaccaaattacacttgtaccccataaatttatacaaatagctttttaaaaaaattagaaaaaataatacaaataaaaaatacagtaaacaaccatttgcatagcatttacatatattaggtattttaagcaatcatgagatgatttaaagtatagtcatgcattaattaatgagggggatactttatgagaaatgcattgttagataattttatcattgtgcgaacattacagactgtacttacacaaacctaggtggtatagcttactacacaactaggctatgtggtacaccctagcgctcctaggctgtaaagatatacaacatgttactatactgaatagtataagtaattgtaacacaatggtaagtacataggagaggtacagtaaaagtatggtattataatcttagggtatcactgttgcaaatgaagtccgtcattgaccaaaacattgttatgtggcccatgactgcatacaggaggatatgtgtagattatatgcaaatattacattttatataggaaagttgagtgtacttgaattttggtatctgtaggaggagtcctgaaactaatccccagcagataccaagggaggacactctatactcctccaactgaggtaccatcagctcaggtggcagaacgtattatgcttactagagcttacaatctaacaaaaccctagaaagtaaacatgcatacatagagcaggtatgcttttgcagtagtacatgactttgggatgctttgcaaccaaggaggtttctcatctctgctggaacttccatcaaaaacagacaggaaacttttatgcagtctaccaccaatgggcatttaggttgatttcatagctttgctattgtgaatagtgctgcagtgaacatttacctgtatgtgtttttatgcctaccaggggttgtagggtgggaggagtgagaggatctataaaaataactaaagggaactaagcttaatacctgggtgatgaaataatctgtacaacaaacccctatgacccaggtttacctatataacctacgcatgtacccctgaacttaaaagtttaaaaaaagaaacttttagatgcttcctagggaggtgactattacaaaggttgaagcccatacaaaaactgatagtatgaaagtttggggaaaatgctatagcagatcattctgccaataagcaggcttcaccaaggttatgagcctaattaaactctcaaagaataaatcccttgaaatattcaaaaaggccgttatgaaatatcaatgttaagttcctaaaaagtcctaaaaaggaagaatggaaaaactctggttgcacatttcacacagatcatctctggcacccccaatgaggacactggagacatgaataacttccaatggatatgaacaaaatttctctataaaactactcatcatggtacagacaaattggttactatcttaaatcatcattggtggggaagatttatggactgatgaggctatttttagatcatgtgtcacctgtcaacccaacagcatcttggagaaactataaaggtggatgtgaaacctcaagaacccttaacaccctcagataggttttgtccaatttccattctccatgaaacttgtatgcctattttcaggatcggttgaaacatttccttgctgaaaagctacagccttcacaatcagtacaaagctccttgataatgcatttctaatttggggcataccaacttttataacaagtaaccaaggctcatgttttatgggagccattgtaaaagaaatttgtaatgcattgtcccttactcaaaaatgacactgcctttattactcacaattttctagaaaagttgcaagaaccactagcatcattaaaattagcaagctttctgaaggacgtgagcctcctttgggaggccaaagttatttccaccagcacttatggccatatggtccacctgctcagagaattactggttatctatctatgaactggtaactggaaggccccttcatttatggacaccacctacagtattagactaccctgctacacaaaaatatgacaaaatagcaaaagaggctcatgtagtatactcagttttatcaccaataagttaagattgacttcttaacttgtttacaatcctttcctacacagcctctttatgatcttcaacaggagatcctgattattagaacagacattagaaaaaactgttcttgaacctcccctgtaagggaccttatcagatacttttaacaacaaatacatcattgaaactccagagatcaatccttggattcatgtttcataactaaagaagcaattcaatattctatacaactggaaggctactccaacagaaaaacttaaacagaattcttagagatattatagaaatagttggtcttcagaagcagatggctgatccaaaacctccagaaaaagatgatcttggacagtagacagcttgcacccaatacatccaacctaaaacccctgcattcttgtttgtttttcaatcttcttacctgttaccactctccttattttccatagagctctgattgtcatccactaataatggttctttttctcttttttttttgtctattataattaagtcagaacatactcattctaatgccattcttatattttttttttcaaaaataagccactgccctcaatattacagactgctgtataggtcaaccagaaccagaacccctgataaaaaacctctgagcaatcctagtctcatcaaatgataccccagcaaattataatcagtgacatttccacttgtacctacatggacaaatgactttaaacaaatcaacctaagactttgctgttgtctctctataccagaaaaagaaccaattcttactgcctgtttatcagactctatataattctaaatttgaattccataatcttcactggacaatgggccaattacttgatgccaggaagacagtaatagagattcaaataggtaaactcagctaatgtgaggccttggttccaacctcatgtcatgaataattctttttgtccatggctgtccagttcgtgacaaaaattcctggtctcatctgcctcaggctaacacctcaagtctttttggtacacagaggccctgattctataaatcatcaaggctggaaattctgactcaaatacaagttccaaaatgaggccacctttgaagcattctatcagggagaattactgactcattgtttatatgaataatcagaacagtgttcccaacaccagaaatcgtatacatagaaaagactaagaaatttaacattaactctaacagaagttattaacagtaccaactctgccctagatgtaatacacatcagtcttaactcatcagcagtagtaatgcataatatcattgctctaatttcttgttggctagccatggtggaatctgtgccaatagtaatacttcttgctgtacatgaattaataaaacaggcaaggtagtacaggctatatgctaccttatgaaaaagctacctaaatctctaaggtgatcctcatgccctgtagaaatttttctcacagcctgaattgggcaatttaggttcttggacccaaaacatcttataaggactataaactattcttctttttgtcatagtgctcatgatgctgatctgttgcatgctatctagagtcttagatacttctgtgcagccactctcttatcagatgatagccatgatgataacacaacaaaaaggtcaagatcttgggaaatgatgactatatgtacaactgaacaatccgtaaatggtgaaggtcttaagccttccatgagaatgatgcaaaggtgagactgagactaaacatacaaatacacaaaggccagatttttatatatatatatatagtcacaatatatgaaaatagcactctaatgcacaatctccacagcaatgagcctgggaaaccaaaccacagtctgcaggcttcagacagcttccctacattttgtccctagtctcaactcagggccaaaagaaaaatccaaatatgcatcccaaaccaaacacgtaagatgccccacttccagatggcttacctccagctttcccatgccaagaatgtcctatcagagcatgtatagtatctttgcttttttaaattcaatataaggctttaccaccctcctgcctatctctgaatctctgaaaagtgcaagtgatggtatgtggaactataacaaactctgaataaatagtttgttatcatttaggtagttttaatttattttcacacatccttgtacaatgtccacaggcaacccagaatactaaactctagcaagtgtacccataatgtaggaaagtaaatagaccttaaaatcaccagttctgatattcaatatatatctaaccttggaaaagattgttaatatctctaagtcctagtttcctcttctgaaaaataagagtaatgtaatcacctaaatggatttggtgtaatgattaaatgtcatgatgatgatgatgatgatggtttctggtagtagctatgttcttcagatgggatggtaactgtgtcttgctgtttgctacctaatgtgagatagtatatgattttgtgtgtgtgtgtgtgtgtgtgtgtgtgtgtgtgtgtagtgtagcgtataatttcaagcatatacagaggtacacaaatagtatgacaaatctcaatggattcatcacccagttgcacaaattatcaactcatgggcaatcttttttatccatagtccttctattcacgcttccattatattttgtttgaagaaaatcccaaacatcattatttcatttgtaatatttcattatatatctttaagaaataaagactcttatgaaatataaccacattattatactcctttaaaaatccttaatatctaatatcaatttctcatgctatgaatctaatatgatgaaaagttcaacattgatttatatacacttcaattgtttccacacatttatggctccttttcttcatttctatttttctttaaaatggtgttcataaaaatgtatggttactaactggattacttctatatttttgacaaggggcagaatttggaatacaactgaattttgtctccattaatacctaccttcactacctttggtgaatattccttatatcttataatttcttgctattttaatatctaaacaacctagagtaggctgtgtaatatttactatttagctccttctagtacagtgaaggaattacaataaaatgatactatggagaatatgcatggggcttcacttaatcaatgtcataaatatccatttaaatattttcaaaatatttaccagttcccttagaaataatttacttgaggggtgatgagttcttgcttgtctgattcatttgtaaggttcagtttatttactgaggattatcgatgtacagttaccagtaaatttagaaagtatcctgtaggttgcatatttacgaaaagtccttccctatcatttatcatcctctaaacacatcctaaccacttttgctatcatcagttttgagcaattgattttcagaagcagacatttgaggggagtggctgaaagggaggtcgtttgagcattgctgttttatgagtcaataacccacctcaatgaaaaagaattaatttcactgaggtaagtaaaatgtccttttaaaaggataaaatgaaaatatcatacattcattctgtatagttacatcgttagattttctatttttaaaaatttcctctggacacactttattttcccaaactatagtaaataccacagcaaacaaaaatttttgcaagccttatggaattaaaaaaacaacacttagaatcaaaggacattcaactagtgaattattgcacataagtcttaaacttctttgactctttttgtgaacagcaggaacagtgaaattaaacaaaaaattattaaaggatttgtttccaactggataaaaaggaagatggtaaaggaaaaggaatcttctaagaaaactgtgactctttaatatcttaatagaacatatattagtcaaatgtaatattaacagaaatgtctcatttgtaccagtcaaacaataaaattggcttctagacgagatattttcattccataaatcttaggaaacgtaacttgagatatttagtaaaagcatgccctaaaacccgttaaatctaaatttaattttctgtggtattggctaagggtttgattatcttctttaagtgaataaaatcaactgttctgttaaatattttccaggaaggaaaaccagaagatataattgcaggagacaaggataacctcttcttgcttactgtcattaaattaaggtttagaccctcaatgcaataaaaaaaatcaaatgtcaaatctttcagctataataattttatttttcctggtttattcagtctgcctcagataaaatctgtaaaagcgaaaatgctctgagtcatacatttaaaattttaaaagttgtaaccacatcactcttaccagaattaatcttggcactgtgatgaaccaaggtaagtaatttttctctagcattaagattctcttctatgctaaattccagctatgttcaaacataaggatatcacatctaattattaaaactttgacaaggaaatgatagtagtaaggtgaatgactcattgcctaatactcagctgtcccatgtcagcaaacccattcattcttggcagaactggaggcatacttcagtctacaggtataccttggaatatcaatcaattagggattccttccaaatccaattattaccaacccctgtcacttccaccttctgagagtctctctaatccatcccactgctaataccccagttcaggcccccttcagctctcacctgaactgcaactagggcggccatctgagggatctcccgtttctgtgtctacccagccagcaattgatccttaactgaacaggagatctgtcttcccagagaacaaatctttggatggcaaacaagcaagagagtcacacacaaaatatttcacaatttagtttcaccatagtttatcatattatcgtcccctcactctcccctttctcactcccttcctattcagacagacacacatacacacacacacacacacacacgtgcacgcgcaaactccacattaaccctaatctcacaacttcccagatatagagccactttaataacctttgaaaccacattggactcattttcacattcctacaaatacactcacaaagcattgtaaatatttgttgtgtctattgcctctctgctaaactatgaatttcatgggggaagtaatcgtgtcttagtcttcatcatattaatctctttgataaatattcatcaaagcgaaactaattctaacaaatcaatgtaatataataaatattcaataaataaactatgaatatttaagtattcattaaatgttaaagatgccatttcgacttcatttaattttattggaatttatgttaaaatttgtaaaatatgagtaagaccttagctcgttcaatacaacaaaatacattctagaaatattaacaatgtaaatagattttttaaaaaaactatagaaatactagtaggaaataaaaagtcacatttatatcatgttggggaatggaaaagacctttctaagcatgaatccgaaggcaaccatcaataaaaagaaagcaatatcagctttttcaattaaaaaaaaattccatagcagagttatagcaatataaccttcagcaatgatggaaaaattttataggtacactgtctaatacagtagcttctacccacacataactactggatgcttgaaatttagctagtaagacttcctaactaaatttttaattttatttcattttaggaattttatttcatttaaacaattcaaattacatttaaatttcatagccacttgttaatggctattttttgaacagtgtggttctatcagtttaaataaaatcttctagaaagaaagtaaaaatgcaaaccacaaaactgaaaataaaatatttgaaatacacctattgaataaatacattatatcttcaaaacataaactgttcttacaaattcctcaaaaaattatcttttggaaaaatagttacagatgatatacaaaatgagaaatatagatggctaataaatatatgaaaagcattcaccactcactactaatcaaagaaatccaaattgaaacaatatactgactgctgtcacttcttcagcaccaccctatcttcacctcatttccattggttagatttgagtctatccattctaccttttcttaacaacatctttatcttccttaatcaattatttttctggcacccacctgacaaaaactgaaccttggataaattcaacagtccacgtcatgaactagagatcacataatagaaaaccatatgagacagtaaaaccacggataggtgtggtcttgccacctcattctcagcacagcctggacatcctctacatgttctttaccagttctttctctctctctctgtttctccacactggctgcttaaaccctttctgctctctcaaatttccaaccctgccatcttcctcctatgagctgaaggcctcaccactgcttcacaaagaaattaaagaccatcctagggcacggtggctcatgcctgtaatcatagaactttgagaggccaaggtgggcggatcgcttgaggccaggagtttgagagcagcctgggcaaaatggcgaaagcctgtctctgcaaaaactacaaaaattagccgggcatggtggcacacacctgtagtcccaactacctcaggaggctgaggcagaagaactgcttgaacctgggaggcagaggttacagtgagctgagattgtgccactgcacttcagcctgggcgacggagcaagactctgtctcaatctccaaccagtataaatgacacacagttattacctttctactgatcccttaaacttccccaactattaccacagatgcaatgtcaatatttatttcaccatttgctggatttcaccctttgtttcctatctcctcttttccttgtattttctattctcttcatctaatgcacccatccttcaagcatttaaatataccaaattctctcctgttttgaaaagacacatactgcagtgccttaggaaatcagcctcaaaatccgagctctaccattaccgctgtgtgatcatgtttggcccctgtcatgtttccctttctgtatctacaaaagtggaataacaacaacattccatccatagtatagttacgaacagggaatgaaaaagtttccacaaagcacttagcatggtccctggcatatgataacctcttggaaaacatcagcaatcattttcactttttgaaatgattttgagctctcctcagcttcatattctttccagccatcccccatcactctccttcctttcagagcaattcttttttcttagctaattttagatttaaagaaaagtttccaggtactacaaagagttcccatattccccttatcctggttcccctaaagctaatacattgcataaccatggtacaattatcaaaactaggaaattatcatcagtgcaatactatattaaattacaggccttttccggatctgaccagttttttcataatgtaattttctattccaggatccagtccagaatcccacattgcaactgtgatttctccttagtctcctataatccatagcaattcctttctctttcccagtcatgatctcaacacctttgaaaataactaatcagttatttggtagactcttcttcattgggggtttgtctgatatttattcattattaaattttgaaaacttacattttttagtaagaatgccacagagctgacactgtgtccttctcaaggcatcatatcaagagatcatgatagcagtatgtcacaggaaagtgttttgtaagaattatatcctctcactgactccatttcatttcctcttgcttctcaatctactgttcactggcctcagtctccatcagtccattgaaactgttctggttaaggacaccaagaactctcttgtcatttaaagtttctttaaaagaaacttctcaagcctttactcctagaccacatagtatttttgacactgctgaggactatcttctttacacatgcatttagctgccacaacacatttgcatgatttaccactgattttttattttatgagtgcttacctgcactcaggcccttccttccttcctttccttccttcctcttttatttttctttcttttcctctgtctttctccttctctccttccttcccttcccttccttgtctctctctttctttctttccctccttcattctctcccttactttagagatgggatctcactatgttgcccaggctggagtgcagtgtctattcacaggcatggtcatagcacactacagcctcagactcctgcggctcaagtgatcttcctgcctcagcctcaaagtatctggaattatagactcctatctcttagtgctttcctcagtcccctttcctggctccttttatgataaactacctctgaacgttgagagtgcttatctctgactacacattcttcctagattaatgcatctacatatctggttttacttgctatccagatgcagacaattcccacatcaatgccttcaacacatttctgtctcctagtcttcatcccatatacacaactgtattccaaacatctctaagggatagcctacaggaattacaaatggaacagatcccccaaccaactctactatgattctaaagttgagccttctaaaatatgatttattttatgccaccaaacctactaagccacttatacatataaacacaacaaagtagacagtaggtaaagaatgtcatatggtctttgaaataagattttattaatgcagtctaagcctgcaattagattttgtgatagtcacatcatataactgacacataagctgaccacaaaagaaaagcttctattttaaaaataaacatatagccgtagctgtttttccaatcctgtaattgtatgggtaaaatttaggacatgctacatcactctgtttaatttggtcctcattccagtctgacataatttgggatccaaatgcagtaatccaactagctgttaaattaagatacactgagcaaacactactagagatacagaagtgaggcagagtattagttgtcccttcaatccattcttctctttatccatagtattgcagtttaatctaggtccctggccattatctagatgtgaccctgtctaagataaatataataggggccacatatgtaattttaaaatttatgattgccacattaagtaaataaaggtgaaattaacttcagttacatatctggtttagccaatacatccaaaatattatcatttcaaaatgttatcaatattaaaaatatttagatattatgcattctttttttcattctacgtttctgcaatcaatgtgtatgttaaactcagaacatatgttaatccagagcagccacatttcaagggctcagtaggctcacttgaatagttgagaggtagagagactgcatttatggtacagcagcttaaaccttaactcaatgtacacaagagttgaacaagcaaccacattccaggtcctaaatttgccttctctcctagctgcaaatttggtggctggtggatttccatatttccatatataagataatgtgtttgtgtgtgtgtgtcaaagcagaggttcagggagagagaaggcaatctctcttaaatctgtatttgcataaaaataacacttttgtttagattccatgttaccagtcaataaatataggatatctaaaaattattttattcatttttacataaaactaaagaaactgttattcatattaaaatatggtcatcactgttattattattatttcttaggttgagataagcattgtttatccttcaattagtcatttcatgttctccagtggcagacagcctgggtgaatttatagcaatgggatgttgccaagtttgtttcaattactcccttagcattgtgtcacaaaaaaagtatatatttttatgtatgtatcaaagtgcacatgagaaaggaaagagtcaaagtcaatggcaaataagaaaccaataaataaaatgtactgtgctttaaaactttgttgatccacttcccaggaagtcattagtgtctaataatggcaggtttctccccactgcccattcctgttgactgggggaagggagccttgtgagtggagaagagggtatgctacctacagaactgtgttcacagtgttggtatacttatgtgtcctaccaactgtggctaagcccatggcaggctccaagctgtggatcattttatctttctatttgtcaggtcacagtcatgaccactaatggcacccatcccaaaagtatatgattcttcaggaaatacagcttgagataccaatggaagtatctttttaagcaaaaataggaatataagattttaaaaattattttcttcaccttcttggttagtgactaataaattttttggaatcttttggctttcatgaactgttagcagtcccattatattggctctttcctccctaactcatatgtggtaaaattaaagaaggaaggaaaggaggctgaatgaccattggtcatgaaaacctcaatattccaaaactctctcaaagagcctctcttcctcaggatagtagtttgaaaacagaaaatttgggaaggccacttgggataatgtttggtgtctgttgctgcatcagcgtttacaaagtgagtatccaaacatgtactttttttgttgtttttttcgagacacagtcccattctgttgcccaggctggagtgcagtggggtgacctcggctcactgcaacctccgcctcctgggttcaaatgattctcctgcccagcctcctgagtagctgggactaaaaatgcacaccaccatgcctggctaatttgttgtatttttagtagagacagggtttcaccatgctagccaggatggtctcaatctcctgaccttgtgatctgcccaccttggcctcccaaagtgctgggattacaggcatgagccactatgcccggccccaaacatatacttctttaaaatgcacaaaaactcaatgagtgttattttccttattactattgttatacctaactaacaatgaggaaatctaaggtgtagagacattaaatgacttgctcagggtcaaaagctaataagcggcagattaccaagatttctcaattcaagtccagagtttccaccatgaatagcctcagaatattgcaaaaggctatgctttaggaatggtacttaatagtgttaaaggactgggtaaaataagataacctaccaagaaaaaaagttgtaacttcaattgacaacttacaatatgaaaaacctaaacattggttaaaaaaaggaaactgaaacttttttttattattattatactttaagttttagggtacaggtgcacaatgtgcaggttagttacatatgtatacatgtgccatgctggtgtgctgcacccattaactcgtcatttagcattaggtatatctcctaatgctatccctcccacctccccccaccccacaacagtccccagagtgtgatgttccccttcctgtgtccatgtgttctcattgttcaattcccatctatgaatgagaacatgcagtgtttagttttttgtccttgcgatagtttactgagaatgatgatttccaatttcatccatgtccctacaaaggacatgaactcatcattttttatggctgcatagtgttccattgtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatttacccagtaatgggatggctgggtcaaatggtatttctagttctagatccctgaggaatcgccacactgacttccacaatggttgaactagtttacagtcccaacaacagtgtaaaagtttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatgtccttcgcccaatttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagtagctctttagtttaattagatctcatttgtcaattttggcttttgttgccattgcttttggtgttttggacatgaagtccttgcccatgcctatgtcctgaatggtaatgcctaggttttcttctagggtttttatggttttaggtctaatgtttaatttttgtattaattgaattaatttttgcataaggtgtaaggaagggatccagtttcagctttctccatatggctaaccagttttcccagcaccgtttattaaatagggaatcctttcccccattgcttgtttttctcaggttcatcaaagatcagatagttgtagatatgtggcattatttctgagggctctgttctgttccattgatctatatctctgttttggtagcagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcatgatattttcttcccatccatgaggatggaatgttcttccatttgtctgtatcctcttttatttcactgagcagtggtttgtagttctccttgaagaggtccttcacgtcccttgtaaattggattcctaagtattttattctctttgaagcaattgtgaatgggagttcactcatgatttggctctctattggtctgttattggtgtataagaatgcttgtgatttttgtactttgattttgtatcctgagactttgctgaagttgcttatcagcttaaggagattttgggctgagacaatggggttttctagatatataatcatgtcatctgcaaacagagacaatttgacttcttttcctaattgaataccctttatttccttctcatgcctaattgccctggccagaacttccaacactatgttgaaaaggagtggtgagagagggcatccctgtcttgtgccagttttcaaagggaattcttccagtttttgcccattcagtatgatattggctatgggtttgtcatagatagctcttattattttgagatacatcccatcaatacctaatttattgagaatttttagcatgaagggttgttgaattttgtcaaaggccttttctgcatctattgagataatcatgtggtttttgtttttggttctgtttatatgctggattacatttgttgatttgcgtatattgaaccagccttgcatcccagggatgaatcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattagaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttcggagggtgtatctgtcgaggaatttatccatttcttctagattttctagtttatttatgtagaggtgtttgtagtattctctgatggtagtttgtatttctgagggattggtggtgatatcccctttatcattttttattgcatctatttgattcttctttttttctttattagtcttgctagcagtctatcaattttgttgatcctttcaaaaaaccagctcctggattcattaattttttgaagggttttttgtgtctcttcagttctgctctgatttcagttatttcttgccttctgctagcttttgaatgtgtttgctcttgcttctctagttcttttaattgtgatgttagggtgtcaattttgggcttttagtgctttctcttgtgggcatttagtgctataaatttccctctacacactgctgtgaatgtgtcccagagattctggtatgttgtgtctttgttctcgttggtttcaaagaacatctttatttctgccttcatttcgttatgtacccagtagtcattaaggagcaggttgttcagtttccatgtagttgagaggttttgagtgagtttcttaatcctgagttctagtatgatcgcactgtggtctgagagatagtttgttataatttctgttcttttacatttgctgaggagagctttacttccaactatgcggtcaattttggaataggtgtggtgtgatgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtcactgcacatgagatgggtttcctgaatacagcacactgatgggtcttgactctttatccaatttgccagtctgtgtcttttaattggagcatttagtccagttacatttaaagttaatattgttatatgtgaatttgatcctgtcattatgatgttagctggttattttgctcattagttgatgtagtttcttcctagtctcgatggtctttatattttggcatgattttgcagcggctggtaccggttgtgcctttccatgtttactgcttccttcaggagctcttttagggcaggcctggtggtgacaaaatctctcagcatttgcttgtctgtgaagtattttatttctccttcacttatgaagcttagtttggctgaatatgaaattctgggttgaaaattcttttctttaagaatgttgaatattggcccccactctcttctggcttgtagagtttctgccgagagatcagctgttagtctgatgggcttccctttgagggtaacccgagctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggatgttctcctggataatatcctgcagagtgttttccaacttggttccattctccctgtcactttcaggtccaccaatcagacgcagatttggtcttttcacatagtcccatatttcgtggaggctttgttcatttctttttattattttttctctaaacttcccttctcgcttcatttcattcatttcatcttccatcactaataccctgtcttccagttgatctcatcggctcctgaggcgtctgcattcttcacatagttctcgagccttggctttcagctccatcagctcctttaagcacttctctgtattggttattctagttatgcattcgtcttaatttttttcaaagttttcaacttctttgcctttggtttgaatttcctcctgtagctcggagtagtttgatcgtctgaagccttcttctctcaactcgtcaaagtcattctccgtccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttctgtttgttagctttccttctaacagacaggaccctcagctgcaggtctattggagtttgctagaggtccactccagaccctgtttgcctgggtatcagcagcggtggctgcagaaccgcggattttcgtgatccacgaatgctgctgtctgatcgttcccctggaagttttgtctcagaggagtacccggccgtgtgaggtgtcagtctgcccctactggggggtgcctcccagttaggctgcttgggggtcaggggtcagggacccacttgagaaggcagtctgccctttctcagatctccagctgagtgctgggagaaccactgctctcaaagctgtcagacagggacatttaagtctgcagaggttacagctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgccaccttgcagtttgacctcagattgctgtgctagcaatgagagagactccgtgggcgtaggacactctgagccatgtgtgggatataatctcctggtatgccatttcctaagcccatcggaaaagtccagtatttgggtgggagtggcccagttttccaggtgccgtctgtcacccctttccttgaccaggaaagggaagtccctgactccttgtgcttcctgagtgaggcaatgccttgccctgcttcagctggtgcacagtgcgctgcacccactgtctggcactccctagtgagatgaacccggtacctcagatggaaatgcagaaatcacctgtcttctgcatggctcacactgggagctgtagaccggagctgttcctattcggccatcttggctcctctgaaactgaaactcttataggcaaataacatgtctataagtaaattagtttcttgaatgttacacatttgagctgttaagcttgttttctgtttcattttaagagtttaaatctctgaaagtttggtagaatatatcctctattttcattttcaagtgtgaaagccatatcaataaataagtgcagacttatataactgcaaaaatgtatcttcaagtatttattgtgtacctactatgtgccaaaagctcagtgtgcctcaagcttggggacagaatcatgactagaactcagatcattgtccaagagttagtacgcaacatagtgccatcttccaaaaaaaaaaaaaagaaaaagaaaagataaagaaagaaaagaaagaagtgccatagtggactagatcccttatctactcaggcctgtgatctagaatgacaatagtacatactggaagaaatgatggttttatgatatcaattttataaagctaggaatgtgcactcaaacatcgtcttacttgtcttaacaactcattgtaaatgccttttctttgaattcatttaagccacacttaaacctatctatatattctgtatctaaactcactctctattcagatgaagccaacaaaaaaacaccccaatatacataataaaacactataaagttgagttaaaatagcaacttttttctatactacaattaatatgtttgcctactttttaaaaattgtttaacctagacttacacattatgtcatcaaacatagtcatagtactaagaagagattcagtataaaactactgttacaaaaagggatgagagagtagctgcaggctttcattttgctaaaccacatgactatccttctcaacagaatgtagaaacctgcacttttggtacttttattttacataaaacattcttctattagtttatttttctaaagcattttgcagttattccctggctaatagtaataaccaagaattaaaagctacagcatatgttgaatagctgtattacaccataaatcacatttactgccatttgttaacatgctgttttaatttcagaaaattcaatgacagttcatgaattttgcggaatctcaaaaataatgacatgattttatgttgaagactaaagggatgttgtcaattttaatgtgtactgggaggtcacatggtattctcaaatttaatggtaaagcaaatttagttaaccctgcagaaacataaggagtcttgaacaatcagtctcttggctagccaagggcaaatgaggaatgaagacacttacaagtttaaatccaacacctgagggtgctttgaaaacttttctgcaccaaatgcagctggtggaaagagatactcaaagggtaaggaagaggcggtacaaagatagctgataaaaggcaacagtcacagcagtagaaaaatttagacaactatttgcgagaacttatcatctgagtaatcattctttgcaccccaggtctttattcccaccctcaagaataaagttaactccagctatgtccagatacaggtagttttgcctaggatactagttatcttagtttgttcagtctgctataccaaaatgccatagatcagatggcttaaataacagacatataattctcacagttctggaggctgggaagtccaaaatcagggtgccagtatggtcaggctctaacctgatctgctctttctagcttgcagatggctgccttcttgctttatcacatgagagacagagaggaagcccgtgtgtctctttctcgtcttataagcacactaatcccatcatggagccccaccttcatgacttcagctaaacctaaacctcccaaagaccttgcctgctaatcctatcacattgaggattatggcttcaacaaacaaatttgggatcagggaggacataaacattcagtacataacaatggtcatcaacctttagggtgcctaagaaccacttggggagatttagtaaaaatgcagattactaatccttcaacatttgtgattctgattcattccatctgggaggcggacagaaaacactttcaaaagcagtccaggaaattctgatgtaagggtccactggccacattgtgagaaattctgtcctggcttagcttcaagcagaagggattgcttgcaaagtgcctgtgctgtgcctcaaagactgaaagaagtgtattcagagatcagactgtcctacggatggtaaaagccagaaccaggaggtgccaacagaggtgctcccacataaatgtcaaccaaatggtgctaggtaatatagatgtactcagtgtccaattcccatcctctcccccattgccatggcctttagaaaactatctttgacagagaggcaaaaggaaaacacctggctagaatcctcatatccaatctaaaaataagattttaagatagattttaaggggaaacaatacatgggaattcaattgtgcatatcctaatggagtcactctggccaatgagagctcaccctgagaaagagggcctctcccttacaatatgataacaaggaaaagtcttttgaaataaacaataatagtaataataacaataacaatcctatgaggattatattgaagtccatgtagtgtttttccatttatcagttccttttgtcttctgtgataaacatgaaggaaaatgtatggttgtaaatggtttcaactaacaaaacaataacattcagaaaaaagtcatcaggagaactgatttttcagttgtcctaaagataatgcagtgtagtcagattaaaaaccctgaattgacaaggctttaatagatttaacttctggggcttactttttaaatactgaaatcacaaacttcaacagcttcaaagtgttttgcaacaaacatataatgattattttaaaaacgattattgtttataagcttaaaaaggaagcagcaaaagaaacagcattataggctgggttggggctcacactgtaatcccagcacgttgggaggccaagctgagaggattgcttgagcttaggagtttgagacccggtctctgaaaaataactaaaaaattagccaggtgtggtggtgtgtgcctgtattcccagctatttgggaggctgaggtgggaggattgcttgagcccaggaggttgaggcttcagtgagccatgcttgcaccactgcactccagcctgggtgacagagtaaaactctatctcaaaaaaaaaataaaaaaaaaaagaaaagaaaagaaaaataaaacagaattataacactgagaattaaaattacttttaccatgtagcgtatttccctacaaaaattcaagttgtcctttaaatacaaatacatgaaactactgatgtttcaagtaaaataaaaatgaatgtcttcatagcactgtttgttattaagctatttccatactggatttatgcaagctatgttttactaaaagaataagcaagtagaaaataatgcataattcctacaggccactcttctttaaagatgaggaccttcttgataccaactgaaattgcctgtgtcaatgattccggtgaaatatgcctcagtaaagatgggactcaggaaatataataaaaatctgtcagccaagttccaagtgcctaggaactggtcatcactggcacattgtagagcagtttgataagcattaaaaaaaagtttgtagtgataaatgattaactattgttgaaattaaattgaatactttcatctttaaaatccatttaatttctttaaagccataaggtttttcaaaggttaagatttattatggattttggtttcaggtgattggtaagtaccagcctcagaatgccatttggcacacaaattgattccctcaggaaaactaaaattatgtggataatcccatctctatgtcctgtctctcaaaaactttagaaaattaattcaaaggacagaagtgtaggttgttttcaagcaaacaacttcaaagtgagtacatttttctcctttaaaatacacacagaaactctaaaagggtcaggccatcttcaagggcagaatacttgttcaacatctagatataggctgctaaggctgatgaatgagaatggaagtaagagaaaaagctgacaatcagtcaagggtatcatcccatatttttaaaaaattccttctttggtcagttcattccattttgatcaaaagcatcatgcaaccacttgtttaacataaggaaaaaaaatctcaaaatataagatgaatttcacattactgaagctcacagagaatgaaatacagtttttctagaaccttatattaatttcttggccaaaattaagtcctctcgaaggttaaaaaaaattgcaagactcatcagttatggcagccaacagatcaaatactcatttactcattgtatataagaaaatggtgtatttaaacattcaacaaataaataaagaaaacaaaaatttcctgggagcaccaccagaagaatgatgatgtatgttggtgatagccactgaacttgcagctgaatacctggttcaaggtggatcatgccattctcctaccttctgtgtcacttaaaagaaattcaaattccataacatagcccacaatattctgctgagctgccccctgcctctcttttcagtctcatcacctattctctcctcctcattcacactggcctcccttcaatctctccagttcagcaagcttcatcctacttatctagcactctctggctcctcccctgcctcgtactcacctgctgtctcctgctcatctttcaggtctcagactgcatgtcactccttaaattcagtcattgcctgccccacattctgaatcaggtgctctattttctttcagagtatgctctattcttcctttgaaacatttatcaacacagatgattatacatttgtgtaattattcatctaattactctttccctcattagaccataagatttctgaagtcttatacatggtaactagcacgtagtacaaactaaacaaataatattaaattaatgaaatcccagttctgacaattatattatcttaggtaagtcatccaatttctctgagctttattttcttatctataaatatgggcattaatctaataattttatatattttaacataataggaatatattcacttttgcaaattggaaagcaccactcagatttaagacattatttttttttcttacatcaagattatgaaccaaagaacttttaaattgatcattatagtcttcatttagtcggcataggcatatccagaaaggcctcacatttagtactaataaagcttggtgtttaaggaatattatagacaatgaataacaatgattccttgtaatttacaactgaagttgatgccacatcaggtatatcaaaatcttcgttaagactatttcctttaataaagtttatgctaccatgttacataaaaaggaatcaactggtattatttagttgttctgtttatatggactattttagcaatttagaaaagatgtagggtacatgccactttatatgcaaatatgccttgacaactgtatgaataaacaagaaaactgtaaatatactttaaaagccaagatgatacaaatggccattcatgagtggacttactgtctaagttatttttccaagagtggaaattcattcatgttgatacacgcaattctcacttcattccctcttccaatgacaaggtgaggagatctatgtctagagcactttttatctaagtgaaaggagccaacaagtgccagatgaacatgactgtggtctcatcttttttcaccttaacccactggcctaacgggcctggacagcagaagatttgtgatgctaaaagaatttacttctgcctggatattttagggatttgactcctgtcaggtattgcaacaaagtcaagtgattcaatttaccaggcaaggacaagaaatggtttcaggaaaaaccaaggtgatgaactattgagcatccagttcattagctgtcatccatcttgacatcttcatctttcaagcagtactgcagaaaatcaaagacgtgtagtgcttcccttaaaaaatctgagaaggaaaacatatcctcttaaagttaaagagactgtgaagcctatttcaaatggattatgaaagataaccattgcctcaagtctgaaaatcttgatagatactccattgtaaatactacctgtgcccttaaacacactaatcttaaaaataatatcattaaaatatgtactgcatgaactgctagagtatttttagcttattctaatttgatgcattgtgcattttaatatgcagtaatagttacatgacaaataactgaccttttagaaatagcatcttgggggaaaaaaaagactcaagaaaaaaagtgtttccctgaaacatcagccaataaaacatgggcagtaagactccagtgacatagccaagtactggtaatatcaccttccttcttttgtttctctgctctgcttattcaacactgaggtactgaaactctggggtttttgcacttatatgcagagtttcctggaattaaagagtaatgtaagcaaccaaagacattaaagaagtgattcataaccttccccacctactattctttatcaaggggaaagtgttttatttcaagttcttgaaggcccctagaggtaaaggtgaggtgaaaattatgcttttcttctatatcccacatactactttattaatgctaagaagcactgtaatgttgccttttaattctctgctttctgaaacactcagtgaatattattccagatctgtagttactaacaaacaaaataaaattaaagactcatacattgttctctcctgaatttgccatttaaaacatctaagtcaggctgtgaaagaaaatgttaactcacggctcacatcatataagcaactagaccacaaaacctaaaagattaccatggactctcagaagcctttgtagtcttaaattattggaggacaactaaggaactattcaggtgtacgctttgcccatcggggaaagccctaggtgcaggtgactgaatggctgcttctgaagaacggcatttggtatctgagtaagttcctatacctacaaattacttgcaagcccttcagcctgaaatttcccaatatattattaaaactcttattatctccacactacttgctgctaccaccactaccaccatacactgcatgatttttggccgggaactataccaggcactttacataaggcacacatgtaacacccgcatcaactgtagaaagtaggggcattattatattcagttgatagaaaacagaggcaggtaagatgttctaggcttctgctaagcaaaacatggtccatggaatagcagctacaacatcacctgagagcttgtctgaaatgcagaatctcaggctcaagtccctgatctaatgaattaggatctggattttaataagatatccaagtgatttatatgcacatgaatattgagaagcagtgctttgggtaaatggaatcactcagactcaaactcaggggtctctagctcaaagatccagatattaaaatagtcagctcttcctgaagatgcaagacatctaaagaatgtaaaacattgaatacattcacatttaggaccaagtttttcatcagctgagaaaatctgatactgagaattacaaatttgagacgagaaaacgatgacctgggaataacagaggaaggagatacctggtaagggaatagaagagagccactgggaaaagaaattgggcttaaaacacactttgtgcattttggtttgtccatttcagtttggttaagggagttcttagccaaactgaacagagttttgactctgttcccaaaactctcggctcacctgaagtggtgcttgatatcagacaaccttactggggagctcaagagtgcttaattgaattattcacaagatcactttctcatgaaccaaccactccatatccagacatccctttgctgaatgtacatacttattcttcaagttcttacatcaatcagcccaatatggagctttctagagatactaactgcttaactaagtctgataaatgaaaacatctgtatgggtgaaatttttttaatgcaattttagttgttttttcaccaccatatataataaatcaaactatattaatccatcaggtatccatctgggatcagttttgatggtattcaagcctgataggtaattaaaatgttatttccatgcaaattgcatctgatcttgaaaacagtttcccttaacctgaaattggctaaacatttctctgcagtcttaaattatccaaatttccaagcaaatatttttgtttccataatagaaagggaaactgcaggtcattcatgaatcaagttatcataattaattaggtttagctctattacctttttatttaaaagctaactggatactactatttatccttccttttgtattacagtatttcataactgactttcatagtatccactctaaaatttgttaacactttgatgatacagtattttcatcttttattggaaaagaatttattgctactttcaagcatagtttttttctcattcattatattgttatcataaccacgtggcttataaagatatgcagacactaatgttatatcaatacttatgtctttggacttttcatttaaaagttaattgttgactatgtatttttttattgtgcaaactttcccaaattccacaccatagcatgacttgctaatgaatatatttacaccaagaaaataaaatgaactttgtataagtttctaatataaataaaagggaatacttactttcgaaagaaagataatttcctatcaatttaataattttctttcattttaacggtagaaattatacaccaatttcatgtcacaaaagaggttagagcttgtttttataaacaatgtttgttagattactcttgcccctatcagaggaagatctgaaaatgtaacaaagaagatatatttcatttttgtgcaaatagacatgtatataaagattaaaggctctgacagagcctaaaaatgaagtcctttatttaatgtactagaataatgcatgcattggcagtatgccagctttaaaattgacatagaatgagccttaacttctcctgcatgattcactatcaggaccagaaagccattcagcaatgcttgtcatgtcttgctatataacaaaataacccccaaattttgtggcttataataacaacaaccatcttatcatctgctataaatgtgtgggtcaagaattcaggaagggcctgcctgagaaattatctgtgccatatggcattaacagaagtcacttggaggtattctgctggtggtttggctcctccagagagctcaagtcagctttacctacatttctgcagtcttggtggtaatggctagaagaatgggctcagcaggacaattgaccatagcacctatgctagcccctctgatatggtggcctcagagagtggggtatcttttcatagagtcttggatagaaggtataagtcttctgacttagcatcacaagtcccagaatgtcacttccactgcatttactgactaaatgtaacatagatcccaagacagaaaatgaacatgcattaggtaaaaataaaagaaatctgaatgaagtctggcctgtattttatttttatttattggattattatttttttttttttgagatggactctcgctctatcacccagactggagtgcagtggtgcaatctccgctcactgcaagctccgcctcccggattcaccccatcctcctgactcagcctcctgagtagctgagactacaggcgcccccaccaagcctggctatttttttttaaatatatttttagtggagatggggtttcaccgtgatagccaggatggtctcgatctcctgacctcgttatctgcccgcctcggcctcctaaaatgctgggattacaggcgtgagccaccgtgaccggccccagcctttattttcaaacaaatgttgttgagaggaataaatatgacagtgtggaataaaacagaagctcacacacctacattggcagaaaaagttagatatgatcaataaattgttaaaccatttaacgtttttgccagagaaagaacacaataatttgaagaaaaaatttaaatatggtttctctgcctacaataaaatggaatagagaagagaatactcactaaagagaacaaaggtcaaatagcaagagaaaaatacaaaggcacagccagctgtagatccaggaggacaacaggatggtcctgagcagaaggataccagaaagggatgtttaagaggcaataggatactgcaaaccagatgagtctttatagtttctttagctgaccctgaaagcaagtgatttctaagttacaaactgctgaagagaagaggaactcccacccaaaactatatagtaagaagaaaaagacttgctaaataccatttaacttctgaaacaggaaagaatcactacatatttgtgataggcagactaatgcctgccaccaaagatgttcatgtctttctcccttgaacgtgtgaatgtattatgttgcataggagaattaaggttggagatgggattaagatggctgatcagctggatttaaaataagaagattaccctggattatctcagaaggcccaatatgatcacaaagctcctttaatgaggaagagggaggcagaagagccagaccagagagcaggcataatcagaaagactccattggtcattgctggctttgaagatagaaggtgtccataagccaatgaatgcaagcagcttctagaagctgaaaaggacaagaaaacagattctccctagagccttcagaaaagaatgcagtcctgctgacaccttgattttcatccagagagacccatttcaaacctctaaactccggaactgtaagacaatacgcctgtgttcttttaagacactaaatttgtggtaattttttacagcagcaatagggaactaatacaattgtgaaaaatgaggggaattggaaggaaaaaaattaaagcatttaatttgcaaacaattgttcaaacatgataaaaatgataatgagacttacaaaatatcttacaaatgaaagaagataactttcctgaaagaagataactatccataacacataatgattgacataatcctgtgagggtcatgacaaatatgctctatgaagtgttgggatttcagcttcctgtttcatttcatgtcagttttggcagatctggacttcagtaactagcagtgtgcctagtacatggtagaagctcaataaggactaaatccattatataaactaaaggggactataaagtagaaaaaaaaactcattatcacatatggcttgtgagattaggcacatagcaaaggaaggaagagagaagagagctaaaattatttggaataaaaaaagaaatccaattgagatccaagtgaaatgcaaatacatttctagtgagacatttttaaccattgacgaagcttcttagtttcagttgggtcttcatagcatcctgcaaaaatgcatggcaaagatacagctgaacacccaccagctgaagctgggctgtgattgttctggcaaacacataacccagagtaaatattgtcttgcacgaagaagtgaggaggtggattaggcattgtaattaccatttgctgggtatttggcattctttttaaagatttaatcatttagatgagacttagtatcactaaaaaaggagtcaatatttctgtgagccagggaggaacagcgctgctgttttccttctgctcagctgttacatgtgcctacagaaagacaacttcacctgctacttttttattcaagacagcacagataaagaatcatgagcagtaacttctttcagttcttttttcttcctgaacacactgtgttctcatctattattgatcagaaagtgatatttaaatagggtggcaatttataaaattgcacagggatgttattacattatcttaattaattttacaaccagcactcactcactgtcctttatagtacatctaaagaattaatgtgctgattaacaatagccaagcagactcagatagtagctttcagataagaacttctgttaatcttctgcttgtcaattggaatctactgacataaattgctttaatctgagttcctggcattaagcatttatagaacaacattttgagacactgattattgtaccattcctttggggcagtgcccctaaattttagtgtacaaaagagcatctggaatttgttaaaatccaaattatttagccctttcagagagatcctaattctttaggtctaatgtgggtccaagaatctgtatttttaacaagcattctgaaagtgtctgagccatggggtgaggggtatgtaaccaaacttgttttgcaatcgtatataaatatggacaatatttttgctgaaacttttcttcttttctttaaatgtccaagtccttatgtacatgatctcttttagtcctcacaatgatcttgtgaagtaggtattattatttctattgtaacaaagagacaaagggtttagtcacttgctgtctgtttgctcaggctgccataataaaacactatagattgagtggctaaagaacagcagtgtattctctaacagttttggaggcttgaagtccaacatcaggatgccaccatggtcaggttctggggagagctctctttctggtttgcaaatggctgccttcttgctgtgtgctcacatggcatttcctctgcacatgcatggagagatagagaaaatgatctctcttactcttcttcttataaagccaccaataccattggattaggacttcactcttatactgtcatttaaccttaataagctcctaaaagctctatctccaaatagtcacattggaggttagggctccaacatatgaacttatttgtgagagagggcggaatttagtccttagcccttgcctatcacaaatagtaagtgggatccaggatttgcaccctaattgccctgactccaagcccacaccatctctaccttaccttgcccctcttgccctctgggccattagcaagaagtagtgatgggctactcagcaacagaggcatggaggttggttagatgaatattcagtcttccattaactgagaattgactttaatgtaatcagatcacttcattaaactttaagggctgccttatatctggtgactatgactattttattcctgcaactttattactagtgacatatttgtgctcatggagaaaaatagttcacgaaatcccttccagacaaggatattcagcagtttaagagagggtattggacaaggctcaggaggttacatatgcttctatgagcagctcttccatcttccctttcaatgctagatgccttagctcaacctaggccaacttagtcttatccttttttttatcccaaaggagtaaaaataaaggatacttatcagcatttttccatctcacaatctgcacagaaatgaatcattcattactaaacttcctttacacaccatagcctgataagaaaacaaataaagcttaaagaaaaatattaaaacacatttgtacaatctcataccaatagcaaggcaaagtcaagtcaaaaaagcatatatttaaagaaccacttcttgtgaatgtataaatatttgtatctttgttgggaacttatatattcaaaaataatatacacaacaaaaattatattacttacataagatcatggagagaaggaaattccattaaaacaaggaacaaatatctttttgtaaggatgagttcctgtcctagggtttgaagtctagatatcatgtcagggaaggtatgtgtgggagagagggtcagggtgaatcccttagagtgatgtagagaaggagatggggaaaaaatgtgcaggggagtggggctagatggagtttggggagggtagattatcatcactgactctattcttcctataaaaaatggaaataattaactcctatatttccagcaatataaaatatatataatagtataaaatatatctttcataaaaattccaaatattgtacacatatttggggctcagtaagatcagttaagttgcacaagtcatatagatactaaatgtggagccaggaaatgcagcaaattcagaagtggaatatgacattctagatttaagagtttgtcaaggaaactttggaaatctactgttaaaactcaaactaaaaattaaactccttcactcaaaaatgtgactacataagatgcaaaagcatttatcaataaaaccaaatgtaggagaagatgattccctctcatccactgcaaattcctacctgaggtgacaaaatcatttcctccacaaaataatcacacagtgtgaacttaagtgtaatggtatcttacctttagaacgttgtctaagcaacattataggagggaaactttggttactgaaagatatagcccaaagggctatgctattctaagaaaagaacaaaattttctgtaatgagttttctggtaagcacagaactttgtaaccctggagttgaataatatgtcccatttgtacatagctgatattcaaaaaattcaataagagattcagctttgtggacattaataccatgacatttgacttcccaactatttattaacaaaaaatataaaaatccacaaatatgttataaagcaaaaaaaaagaaggaagagagaaggaagaaagaaggttaaaataaaagagagtagaaacaaaagactatagcagtttagttctaaaggagagggagagctttatcaattattgagttcactctctcatgttacccagtgtggaccacggccagaacacacatcaaaaacacaattcctaccctggtatttttcctattgcaccacagtataaaatgcaagaaaccatattctccatttattaaatataatcataagaaaggcatgacttatgcctatttttaaaattatctctacacaattagtttgcagcattctttatattttaaaatgagtttactttggatgtgctgttaaggtaaataatataaaattgatagtatctttcacagttcagttgacattcacagaagctatccttactttgtctaatatatcccaagcctcattttctatgcaacacaagtaagagactagaatgaggtaaaaggcaactgttaatcaatttgttcttatagaacaacactagctttttccagtttttgtatgtgtgtgccaaagacttattcttatcaccttgagtacataatgaacctcctaggattaggcaggtggatgatatacaaagataaaaagtgagaagtgacaagtgttctagatatctaatgctgtgtaacaaaatgccccaaactgaatgagcaacagcaaaatttattttgcgtatgaccctgcaatctgggtaggatgtaaagtagatagatcatccctgttccactcagcatccactgatgccccttgaggtgtaggggctggtgtcatctgaagtaccaaacaaatagtattagagttggggatccctagacatctcttgtctccaggtggtctctccacatgatttctcctacatggtagcttcagaatagctgagctttttgcattttggctcagggatcccaagacatgagcccaagagagagaatcaggtgaaagccatactgcttttatgacctaactcagaagttaggcaactttgcatctgttttgatcacaagccttcccagattcaaggggagagaatatggacctcatctccacgtagacaagtatcaactgtatgttgcatgaggagaaaatgtgggatagatatattggtggatccactttgggaactaaaatctgcaccaatgtccttccagcaagacttaaagtgacatcatgaaacctgagatcaagagggatttctcctgaagcaaagcataaaatggagaggagattacaaatggagagaccagttaggaggttattgcaattgtcaaggtagaaattatcatggtgagaactagtgtgatgataggaacagaaaggagacttccaagagcacttgttctgacccttttctcaatggaaaatgagagagaggagaaaataaaatagaaatgtaataaagacgggaagaggaacagatctgagcagacaggattaatttggcttagaaaattttcagttgttcttgtggaatgttgaggcagaagtgtccagtggtcattggaaaatgagagtctagagctgtactgttcattaagaccacatacgactattgtgttattgaactgtggctggtttgaattgagaagtgctctaagaaaaagtacacactgaattttgaacacttagcaccaaaaaatgtaaaatatgtcaatattgtttatcttatttcttgaaataatatttcagatagttgggttaaataaaatatattaaaattagttttaccttgtgtctttttacttttattaatgtggctgctagaaaatttaaaatgacaggctgggcatgatggctcacacctgtaatcccagcacttttggaggccaagggggcagatcacttgtggccagaaattcgagaccagcctgggcaacatggcgaaactcaatctctacaaaaaaatacaaaattatctgggcatggtggtgcatgcctgtagtcccagctatatgggaagctgaggtaggaggatcacttgagcccaggaggtcgaggctgccatgaatcaagattgcaccactgtactccagcctgggcaacagaacaaaactctgtgtattagtctgttttcacactgctgataaagacatacccaagactgggcaatttacaaaagaaagaggtttaatggacttacagttacatatggctgggaaagcctcacaatcatggtggaaggcaaggaggagtaagtcacatcttacatagatggaagcaggcacagagagagaacttgtgcagggaaactcccccttataaaaccatcagatctcatgagacttcttcattattatgagatcagcataggaacaacctgcccctatgattcagttacctcccaccaggtcactcccacaacacatgggaattcaagatgagatttggatggggacacagccaaaccatatcaccctgtctcaaaagaaaaaaacagaaagaaagaaaagaaaatttaaaatgataaatacttgtcccattataattttactggactgttggtctagttttgatgagaaagcatatagggaatactttaccctagctctacactatacctgaaagcatgggattgaatgatgtctcaaaggagggaattttaaaagggaaaaaagaggaactgagaagataatcttaggaattctcacaattaaagagtagagaaggtaataagcagaggagttcatagcttcatctcctacatttcctattatatgtttatgtaaatatttactgaaagaataagtacatggaaaatgaattaatgtttgcttaatttaagaaagttcttcatgctgctcagcaaacattctttatttccctaaacccccatctactttcgttctcctaaacaactatttccttccgtctcttcaaaccttgaacctcaaatatttcctctcctatcctcactgtcagctgatgatcttgcatccccattctttaagaaccagaagcaattacaagggaaggaacctcttccctaagctttgctcccacccacctcatctggtctgcataccttcatacccatctcctctccctttaccatgctccaacttagccaacccttccacttgtacaataggtcccagctccattcgaaaaagaacacggccccaacagtactttctctcctgcaccataatgtcccctctctactggattgtttgtccaatcagtatagaaaagtgctgtttctcccatcttaatgcagccctcttttgatactacttcaccctccagttattgctttttctcttcttccctttgcatcaagatattttaaaagagttgtctatgcatgccgcctccagtttctcttccttatcctctcctgaatctacatcaatcataatttccaccatccagctgtccttgtcaaggtcactaataaagttgccaaaccggctctcagtccttgtcttatttgaccgctctaaagcaattgatgcagttggtcattttcatctacacttggcttccagaacagcatacattcctggtttaccttctatgcccctggctgttcttttcaatatccttaattgaccccttgtcatctccctgtcctttatgtgttggagtgcttcagggcccagtccttagagctcttatattgtttatgtattttctaagtcaatcccttccatccaaacacacctggaacacacctgtagttgagaaagttgggtttattactcactacaacagggagaacacatactcatacataggtaaccatgatagttttagtaagatgaggttagaaaggattattacaaggtttaggatttggttggatgattttggagagagtccaaggaagggaagtttcactgtggactgagtgctgtctgaaacttctatgattatctcaataaatcttatctatagagaagggcagactagagcaaagctacaactgtaactagcaaagaagcaacagttaataatcgaaataggaagatagttgatcttctttaaaaaatattcatgttttgtctgtgtctattttttcttgatccattgtggtcagagtggccttgcccaatgttggtgttcaatgcaattgtttatgggcaacaggggaacaccagggcttaggtaacagtgcgaggcaggctcctgaatgtcaggggttgcttttgtctaatctcatctaatcccatgactttaaattccatcaatatactgaatattctcaaatttatatccctagttcttatagccatgaatggccatgacagccaaaaagtcttcacctacaaggcttttcatactgaacatatctgaatctagtgtcctgatggtcccctcccaatctgcttattggggtacacttccccatctttgtttagataactccatcctttccagttattcagaccccaaacctttcttgactcgtatatactttatctatcatacatctgatatttggcaaatcctgatggctgcacttacgaaatgtacccagaatttgagaacttgtcacctctccagggctatccctctgttccaagtcaccatcatgcccctcctggactactggaataactcctaactgcccccaccctgattctaccttttctccacttaagtcgattctcaactcagcagccagaataatcctgttagaaaataagtcagatcatgccacccatctgtggaaaaccctcgaataagttcccatctcaaagtaagagagccaagagcctttctatgatgtgcttggtctggatcttctatctgacctcatctcctgttatccccatcctaacccacactgttttagctacacctccttgttgtcctttgaacacctagaaaatcatctatttgcaatggtcttctctgcccagatgactgttcagggcctttgcaatggtcttctctgcccagaaaatttcttccccagctatctccatgtattccttcctccattcccccagggttttactccaatgtcatctcagggtgttcctccccagcctttctgtctaaaatggtaacctcccacgcctgacatttcccctccagattaccctgctttatttttccccttagcacttacattactctctagctaatatactatatatttaccattttagtgaattgtttctctcctaacccccatagggacaggacttttggttttttcacagctgtataaagagtactcagtacgtatttgttgctcgagtgctgtattgccatgccagagagagtagatactgagactgaggaggatggctgcctggcagagcagtctggcccacatctccactggctggaggggttggtgttaaatatgcataggtgtgatgctgtttctggttccgatctcattcgtggatggagatgtctacctgtcgtgtatgctcaagccaatggcactgtatccatctgagtcatccctccctgcccagagagtgccccgctccagccattctatgtgcctgtttctgtgtatcccagatcctaggcagccaggcccagcatgagccataacattgtgctttgagctagacagcagcgcctgacatgttgtttttcctttcttagatatcattagacaaaagcttagctagggagttggaggaatgtatcattacaaacaaacaaacacaaaaatcgaagacagtagcagttcctcagttagtagctggaagggccacaggttgtcaatagcaggatggtattcggtaatcattacccttctcttttatcctaattaaattatcctagtcctaacaaaaggaataaatgaaaagaaagagctgacagtaaataggtttatagaactgaactagaaagattagaaattgcttttgtgccaaattggaacatttaataaaccttcttagaaatcttaaaatgtattgagagtattttctttaagagaattttcaagtgttgtatttgcaaaatctagtgatgtgtgacttattcctcacaaaatccagcctgtgtaattaatctttgatcaaaatatgtgtgtgttatatactttcatatatttatatttatttctgtatatttattttcatatatttgtatgcttaaatatatgtatttataaaaaatggataaaattttacctttttgagtatttttaagttttggattgtccttgatcataataatcataatagattaacatttttaatttagttttgttcaaatgacttagtgttgctccaagcagtttagaagtaaacagtaactttgctagcatccgcattattttcaaagttcagagaaaacaattttgtgatggatggaatgtttcataaatataggccacaagtccagggttttcaaagaaggatgtatcagatggaataataccagtagtacttgcttcctccgtttctttcagccattttatgttaacagtgatgttacttgactggccttagaggatgaaagaatcagaccactggagacagtgcatgctgaatttggcatctgcttttctctgcatcatcagttactagtgttttgtttgatctgtaacatgtaataacagatgatggaggtcgcaaggtgttttttttgtttgttttttttaagtctttgttctctttattttgctgtgttaaattttgcacttactttaagaggctccaggtcatagaaagaataggtgagcctctaatggacaagtcttgcagaggctgccttctagagacaggaagcctggtttctgacttaacctatgaagcagttaggactcttcctggacccagaaaaacatacaattgaaccaagtcgttttatgcatgacccattctacataagtaatctttgacacaggattatgtatacatatagacttaaattcgatatcattgcaccttgatgagcaacaagtagcttaagcaaaaaagggactttactataaggatacagtggcagtacctggaacctaaggcacctatgaatggtgctgggcctcaggaatgggcaggacccaggggccatatgcctggaggtgtgctcctgttctctcccactcctctcttcacttgctctccaacttctccgttatttgcttttcctctttcctctctctcctttgctttctcccagttataaaatctgcttttcactatgcagtaaaaaggaatggatccttattggctctggctgagtcaggtacccatgcttgcccatcagtggaagttgtggtcaactgggaaaacatagctggaaggaggctcacagctgtaaagactggtatgtgaacatcagggtaggagaactgggggtggggtgtggatgcttcccagaaagggaaccgggaaaaccatttaatgtgtctactgtaattctttctggttcagtgagccttttagtgggcagaaaatgagttgctcccaagttttaaaatctctcacagtgcctttgtccctgttccctaaacagccttttccatggttcccctccgccagtggaataaagccaaaactagcttaaatgtaacagggaaatccttcatttagattacatcaacctagctttttcttttgccactgcctctcttacaccatgaagtccagaaaaattgaactatcttccatctcctgaaatggctttatctttcccagctcttactttcacttggatggtttaatctagtggctatagttttagtatgcatcagaatcacctggaaggcttgttaaaactcacatcattggaagaatccacagaatttctgactcactaggtctggggtggaacgcaaaatcttacatttctcacaaattcccaggtgatgtagaagcagctggtgctgggatcatgccttgagaaatttaatttctcaggagtgctcttccacgcatctacatttatgcaaatgttaagattacttcattcttagctgctatgtcttattttgtcttccttagctgttaaaccaaaagtaatttctgtctttactgtgcttctgtagctagttggaattctcttaaaccattacctaccttgcattacaattaatttgtaagtgaatattccttaagggtaataataacttacctatttttgcattatccatagtgcatatcaaaaatattttctaggcatatcactggtgaacagcaacaattttgactttctctttactgttttggatgccctttatttctttctcttgtctgattgctctggctaggacttccagtactatgttgaatagaagtggtgaaagtgggcatccttgtcttgttccagctctcagggggaatgctttcagtttttccctgttcagtataatgttggctgtgggtttgtcatagatggcttttattaccttaagaatattttctatatatttttaattgaattacagatgtagaccataaccttaagaaatatgaatcctttcataggaaactggagagtatttcttatttttttcttactcataatagttgtaccttaattcttgacttacatggtccatgaactacagtttgtgaagaggtgagtggataccacttttggatcatctacattgtgctagctaacttgcatattttattttaaattctgtcagcaaccctgaagatacatactgttaatctcattctacagatgataaaactaagtctcagaacagctaggaaacttgtccaaagtcacggtaggaagtcacagaaccagaatttgtaaagggcagcccttatgatttatctttttttttttttttttgagacagagtctcgttctatcccccagccaggctggagtgcaatagagtgatcttggctcatggtaacctctgcctctcaggttcaagcaattcgcctgtctcagcatcctcagtagctgggattacaggcatgtaccagcatgcctggctaatttttgtatttttagtagatattgggtttcaccgtgttggcaaggctggtctcaaactcctgacctgaagtgataaaccgccttggtctcccaaagtgctgggattacaggtgtgagccaccatgcccggccctcttatgattttttatatcccacacttccttcccatggagaaaatacttaacactgatcatgaagtgaactgccagcaatcaaagaggtgataaagtccctggaacacagcaggtgtccaggagaagatggcccaaccaggctgccaggaaaacactcctggcttcctgatgccatttgccatgtgaagctgtatgccagatgctggattgtgagaatggagagtctttccttaaaggagaaaagtggcttcaatgattaagaagcatgaactttcatcagctttttgtacttcttctcatatattactaaaaatctacgttttttttccaaaagtaaattctgtcttttttttttattcctgaactcaaataattaataaaagaacaggcttatatgcaaaatgttacaactacagaccttactggttcaagtaattacttgaagaaatatcatatcttaaaatatttccatccagtgcatcctttttattagcactctataaatttgctgtcactgtgatatctgcagggaatgcttataaattaaaaaatcaaataacaaaactaacatcgccacattttttttttaacaatctgttctgaaggatctgagtagatgcagttgaaatatggacatacagtttgagtgattagaatttataggggaaacagtaccatttctacatgactttcatttgcatttgtttgttattctcctaattttgtctgcagtagccttggggatgagttctgttacatcgtgatatcttcctttatataactaagtttagaagtcaatcagactactgaataaattcataatatctagtcccatgatgtagataaagcaggaaatattttagctaattcacttgggggagacttcttgatgcaaggaattggaaatgggagcaaatatacaacaatgctaagtcatcacctaaaccaagcaatgataaaactttgaagcccttaggtcagggaaaagttagtaagttacacattgctgtttaattcttgttatggggaatacccatcaaagtgacatattatccactggaagattcgtgcattctttccttctgccctgtaggtggcagacttcttggctaagacaattacctcttcttttgtggcatttggggaattagcatacctttcttccagtcctttgagaaagttctctgagactagattcttgatgcaaaggtcttaatgataaagaagttctttgtaattgcatggtacatttactctgtggcaaaagcaaaataaacattcttttccatgaataggaagatctttacgcaaaggatcttaaaaattgacataattactcactagagaaactatgcctattctagaagggacaagggagagattcaaataatagggaaaattctgtgtactaccacaactagacaggagggtatctttgcttttattaatgcctagaggagtctgtctaagctttataaaacctcttaaccaaatggtgttattgcctgtgattctgcaggcaggggtggcagctgcattttaagcaaccattttccactgagttacccaggtaaagaaaggaagttgaatatctgacctatgggtagaagacatgtctcaacccttaaccctcacaattgcagtgagccatcttctcttggcatcatcatttgctccctaaaactggatcacttccattcataaacaaatgtgttctaaaaaaagttcaccttaataaaaaaagaaaagaaatcctcccaagcttgactcaactcccacttgtgcctacaaaatcatttctatgctttctcttggagcaacacgtgtcaggtgagacgaactgcctacccaggtcttctttacttctctgtcttattcatcctgtggttaaaatagcctttgtatattgttgattctcaatcttcatctcaaggctgcacagttcctctgcactttagactcctatgttctattatattactggatgtttactaggtacctaaaacttgatacattgaaaatagagaacatctgtggtggcagatgcctgtagtcgcagccacttaggaggctgaggtgggaggatctcttgagcccagaagttcaaggctgcagtgagctacaatcctgccactacatttccagcctgggcaaacagtgagaacctgtctaaagaaggggaaggaaggataaaaggaaggaaggaagagaggaagggagggagaggaagaaacaattttccactctccacgcactaaaatctgagccttcctagtcttcctcatcaaagaaaataataaccccattcacccagttattcaagccaagaacttggtaattaaccacttcccttcaaccctacactgccaaagaagaggctggatctgagatatacatttggaagtgatagaacttgcaagatatcttggtggttttgatctagggggactccctatatctacattgacccctacagtcccttttccaaggatcactgggagtcatagtttaaacacttaaatcaggtcactccttctactcagaatttttaaatttactcctatttctcttacagaaaaacccaaattcccaaacttgacctataagcattggtatgatcagactcctgcctgcccctccaaccttactgcttacctgtctccctcacacaggatgctcaagccacactggcttctgttaaataaaaattatagaagtccattgttttgaactaagatcctgcacttggctccaacagataaagggctaaaagataaaaactcacaccaaagttctgtcaccaaacaaccaatttcccaaacaggccagtttcaatcttccattggcatgataatgaagttccctctgctttaagttatgtttccactgttctgtctccctactcccgccctgcaagaaaagcaacgctgaaatgaccctctacttcatgttccttgtttctgcttttttccagtcctgttaaaactaaccccctctgatcaactcattggaacacttacattttatggattctagattcacaaataaagccaattgaggtctttaaatttgttgtaattttgtcttttgacactcctttctgttccttgaacaggacatactttttcccatttacctgaggcctctgccttgttattggttttccttgctcttttcttggcagtcccagtctaatgtgtccctccaccccccaccccacacacaccaccttcccagaccttcccagaccaccacatgataaaacagcctccctaaaggcagcagggttggtttccatcagggcacatatacctctccctacacatccccacacccctgtgcccacccccagtcccctgcccctgtaatttaaaatctccttgctggtttgtttgcttacttccctctctggttcaccacgacaggtcgagtacctggcacagcttgtggcacacagtaggtttttcattgaaatttattaaacgtgaatagataaaagttgggcttgcccctactaaatttgacaaagtgaagtcaactccatgtcagaagccctttatcaccccaccccagattcccagggaattaactcatcttgaggtatgatggaccaagatcagatctgttgcactttccccaagctatttgcaacttaatggagagggaaagagaaaggaacaagaagtttttgtgtatgtgcagttcacattttgaaagtgaagcaaatgcgcttatccaaatgtgaaaagtagcctggatgatcctcagtatcattctgttttataaaggatgtaccattcatgtttaagagccagtgcatgctaatatttcagaggagatgggtactttgagagtctgatgcaagtttagacagaaatctaaatgaaatgcatatacgtaaagataattacatacaatttgagtggggcatgggcctccagaaacctatccattatgcatcctgaagatcctaaacaaatcgtccttctattttactatgtgaacaagattccactttctttcatggtaaatcctgggtcattgattttgtttatagctcttcctaaagcaatttgaacttccccactgcccttatagcttgaagagaatatgttaactgggaagagtgaaaggaaggaatactaacatgtgttagacacgaaaatgtatccagcactctgcaatgcaagttctgaggaatttatttctcaaatttaattctcatatttatttatttattacagaattaagttatcacatttaactataaaaacaatccagtaagactgtgagtcccatttttgcagactgaaaaactgagggaacaaaaggacaaataacttacaaataagaagtttatgatggagcctagattcctatccagattataaattcattttctgaatcttatactacatattcatattttaaaagtggctgattcattctttcatttaactaatgatctggacacctcctcctcaactctctgacttcgtcttctgttgctcttccctttgctacttttatccaagccacattggcttccttcctattccttaatctaacatccttaaggaaaagtctgctatagaagctattaatagactattggtggtgagtctgtaaaatataattatttatatgaataagaatctataccttcttaagaaatgtattttggtaaaaattatttagaagatgattgcctctactaagatacttgcaatatagatatatttgtgaaattaaaacatattatccattctaaagaaacaattactaattaaaatggttacagaacaaatagttttacaataaaagcataaacaaaatctcattaaaaatgtgctaatattttacccagtttgtagatattaactccaattcttttaaacagcggcagatttatttatggaaactgcaagcataatgagttcaaatattctactacattctatataacacatttactggccaaaacatggcttttaaattgtgactattggaaaaatactgcacatttttatatattcatgtccttttgctttttaaaatatactttttatatattcatgttctgttgcttttctggaaataaaatcactctcttgacctgtgaatattagtatataactgagaaaacttataaataatgaagaatccatttcgtatggtgaacatattaaaattgttgtatggtttgtgactcccacaatcactgtaaatctttcatgggtgaattttcctctgtggccttcagccatgctcagacatgcatttcccattccataccagctagctattctcctgctgttagatcatgtaccaccaaaaattaattttcctacccagacattattataatactgaagttgctgtgaatccttccctatccatatttttattttccctcatatgtatctatttataaagagtgtattatactatgcttttatttgtttctatcaccactatgctctcaatatttggccaatgttagtacatgaagatatagtgcatttattttaactcttacataatatgtcatatataaatggtaatctacattgtttccaatttttcactattaaaatcaatgcagctattaacatccatggcacatacatgagaatttccctactattactagtatagaatgcaaattttcaacattactagatattgctaaactgccctctaaagtagtttgaccaatttattctcccaccactagtatttgataatttccaattccctataacttctcccatatttggtacggccagatattttcatttttttttcttacctgatgagacataaaattttatgcccttgatttttttttaaacttgtatgatcttgattactggtaagcttgaacattttcttatttattggccattttcttatgccttgttataaactccttgttcccattcttgagtttttattctactcaatcaattggttttcatttcttactaattcgttggagttataagcctggaacctaatctttttattttcatttgttttgttatataaaaagactcaagtatatataacacaattatcattttttgatctgtaactggccttttagctttttattttgatatactacagcttttaagtggttgtggtgtagttaaattgatctgtcttctcccttttggcttgtttttgttttgttttgtttgggttttgtttgtttgtttgtttttgtatgcttttaaagaactctcttgctattccaaggcagaatatatatgtatagattcccctatattttctacaaaatttaaactatttttgattcaatatctatgtgtttaaatttgtctgcattttagtttgttttaaatgtcagctacaaactcaatttatctttgtatttgtacaacttattacttcaatgtcaacaataatctatcctctcctcactgatttttaatgccatcccattaatttgatgttttatatggtcagtttctgagatctctattctgttttgtaataaaggtacaaaaataataactagatatcttataggcatgttatggctattattgctactttgatttttttgaatgtaatatttttctttgcttctgtattacaaaaatattcttaaatgattcttatatacaacaaaattattacttctaaaatctgtcagtaagtgctcttggattttctatgtacatactcatgcaaccattttgttctttattttccattccctacatacttttcttaactttattgcataggctaggacctagctacaataaatattaactgactgcatgcatccttgtggaagaaagcagcatttttactactaatttaatgctttaaattataatattagtatatttagatgttctcttcctatgttgatattgaaaatttatatttagaaaatcgttcagttagtctaagatttcaggttatttagcataacatgttcaaattcttctctcagaatttaaaaatcttcactagatctgaaatgatatctttttttatttctcatattgcctgtatgtgttaatgtgtgctttttaaattgatcgattttgccatgggcttgtctattttaacatccttttcaaaaatccatcctttgtattttgttagtaatttctccattctttctgtttgctattgtattactttgtgcttcttcttgtatgcttttccccttcccactttcattagaggttctctgctattcctcctctaactgcttgggttgaaccttcttttatttagttccaaatgatctatttcctgatatgtacattcatttttggaaacttcaattgaagtgatcgctgtatgccacaagtttttatatatactatgttcactgatttagttacaaatattgtttgatagctatttaacttgcttcattaactcatgaattatttagaagtccatttttaaatttccagctatatggggaagttggggctattttttatagttggtgccacattttattaaacttatttcatggaattttgtgcttcttcttttgcagtcatctagagtaataataccaactaacatttttcaagtatttaccatgtgttaggcactattctaaacagttaatatgttttaacttgttaaagctcacaaacgcacaaggtactatgatgatcagtaatttacgaatgaagcatctgagccatagcaagataaagtaacttaaccaagtaacacagctggcaagcggcagtgctaagacaagcttagtcaaacccatagtctgctcctataaccaccacaaaaaaacctacctctgaatttagtgtgctcgagaaaatggatatttgcgttttcagagcatgcagtcatacacgcatctgtcatatcagcttcagtgagttattgaagtcttctatattttttctaaatattttcatctaatttattaatttctgaggtaaggtgttaacatctcctatttggatagattcatcttattttgttaatgttttgctttgtacattcattttagttcataatgcatatttgatatctttattaatatttctctttatctttactaatggttaactataaattctattttgtctgatattaatttactataccactgttttttctttttgttctaatttacctggtatatcatttttcatttttaattattatatatataaacatatacaaatatatacttggttaacttactttatcttgctatgtgtggctttttttttttttttttgtagagacaaagtcttgttatgttttccaggctgttcttgaacacctggcctcaagcaatcctcctgcctcagcctcccaaagtgttgggattacaggtatgatccactatgcccaggacatcagtacctttaaagattaccttcccatttcattcctatccatttcacagtttcactgtgatgtttctaagtgggcctggttgttccttcagtctgggaattcacttctctactacatacagttacctacttggctattgcctctccttcattatttctatactcttattctggaattcctgctttagattttttttattctatcctcgacagctctatttccatatttctaggtctacgtattccatcatgggtgatttctttataattaacttcaaactcactaattacttaattagctgtctggtccattgtttgtccaatctattgataattttatttctagaaatttcattttagttcttcataactgcctacgaacctttaagtctatacttatatacatatatacctatgtatacatacctatatatatatgcctatatagctttaagtctataccttttaagatatcaaatttattttttaatgtctcagattattctatatttctagacttgattatttgctgattctacttcagactgattcattttctgatattgcaattttttttactatgagctgttgtgtttttattttgttttggcagttgttttgcatgaaaccatccctacaagaaatcatttctatagtacaatcagtggtctcttctgctgggaccccatatatggtagcagttacaggccaagttttgcattattttctctgtttgggattcctacacactattgtgagcatagtgtaaattcagagcctactctggtacagggcacagatgtggtcttgccaacccatagccctggacaaataaccagttttctttcagcttcctaaggctgtggagactttttagtactgtgtttgtgagctaagcagaatcctagctctgagatttgttcaaggagcttggctccaattccaaacccagcttcagcatccagtattgatttcccatgtcaacttttgatacttcctgagctctcttcactgagtttcttctttgtttataaaacttggtgatttatcttagttttagcctttcttggtattggaatttttaatatcatgctttttccagtgtttacataattttggcatggaacaaagaacctttgatgtcacatcagttcttcatatcacttttggtgtttccaaagatcatccttaggctttattcttctaatcaagaaagaacttttattttggtaacagctttatagagatatacttcacatgtcacacaattcacgcatttaaaatgaacaattcaatggcttttaatatatacatagcacagctcatctatcaacataaccaattttagaacgtttttattacccaaaaagaagccctattccccttacataccactcttcaatcatcctgttcccgtcccttcaccatccaaccctaggcgatcactaatttacttttcctctttatagatgcacccattctggatattccatataaatggactcataacaggtggtcctttgtgacttgtttgctttcacttagcatcatgctttcaaggtttatcaatggtgtaacatctatgagtaatttatttttattgccaaataatattccattgtatgggtatgccacattttatttgcctgttcattaattgatggatattcgacttgtttccactttttggctaatataaatgatgctgtcatgaatattcatatacaaatttttgtgtgtatgtgtggtttcaattctcttaggtacacagctaagagtagaaccggtggaatatatggtaactttacttaactgtttgagaaattgccagactgtttttcaaagtggctatagcatcttccattcctgccagcaacgtaggacatttccaatttttccacatccttgccaaaactcgttatctgtcttttttataacagccatcctggtgggtgtgaagtggtatctaattatggttttgattttcagttccctggtgactaatggtgttgagcatcttttcaggtccttattggccatttctatacttttctttggagaaatgtctgttcaaatcctttatccatttttaattgggttgtcttttattgagttgtaatagttctttatattttagctacaactgccttatcagatatgtaatttgcaaatatcttctcttattctgtgagttgttctttcactttcttggtggtttcctttgaagtatgaaagtttttaatttcaatgtcccatttatctattttttccttttatttcttatgctttttggtggcatgtctaagaaaccattgcttaatccaacatcacaaagatttatactttttttcctaagagctttatggctccagatcttacattcaagtcttgaatatactttgactcaatttttttttttttttttttttttttttttgagacggagtcttgctctgtcacccaggttggagtgctgtggtgcaatctcggctcacagcaacctccgcctccccgattcaagcaattctcctgcctcagcctcctgagtagctgggattacaggtgcatgccaccatgcctggctaatttttgtatttttagtagagatggggtttcaccatgttggtcaggctggtctcaaactactgacctcatgatccacccacctcggcctcccaaagtgctgggattacaggtgtgagctaccgcgccctgccttgactcaatttttatatggtttgaacacagtggtaatttttaaagtggttatcacctgtaacagtcttctctaaactaaagatctgacaagaaaatgacatgatttggggcgtattatgcataattggtatcacagcaatattaggggatatgagacatcagccttcctgatacttcgatctctttaaaaagcatggaattataaaatcttagttcaaagtcattggtctcttacatatttccaggtgtgtgttttcctatggttaacagaactaaaaggagacattattgtggcaattttgatataaggaggtagtgctgtcccactaagaactaaacaggtcagcgagttctcaccaatctgagtcactagtatgaagggctctgaggaaataaaaaactcatttacataggctaatttcttacactgccccgatgcagccttgttccaaacattcgctgttgtgatttacaagaaaagaaaaaaagtagtaaattgggcactttcttacccaaaccactgtaggtttatttgacatttagttgtattgactggagacttttataaatttctggaaattgatgtcaatattttcaagtaatgaatcaccagcaaagaagaaaaagcagaggtgctttataacatggtaaatcccagtaagtaattcttgtctgcatttctttctatattgcagtatcaaaaaaatgagacattaaaggaggaagagagaaaacgatcctatcaaaacggtcagttggaacaaaaaataacaataatgccaacagagaaatgagaggagtgaaaaaagcagaggaaagccagagaagaacagaaatgagaggacagaggtgaaaggaggagacaagacaagaaacccaggaaaagatgttgtcatctacctgctttaaaaagtgtgcagtgtttgaaccagggccaaggtcttaagtgggattcaagcaaagtaataaatccataatgaatctaaaagtatttataaagtacctcaatattagtaacagcttacagcagaaaaaaatatatgatcaggacctaaggatactttctatcataaaatgttaatcagagaaaaaatgaagtgtgaaaataaaggtgtgaactctagcagagagcatggtaagacatagagcttggctggtaccctctgggcccccagctctcaggctggtgggtgagctgagtgctctcaggcacagggccaggcttagaccctgatggcagcaatccccatcctgcctgtgacctctccaagccagacccactgggccacagctgggcccccaccatgcccagagtaaacaacactactgtgtgaagggcatggaaggctgggaagaacacggcaaccccaacccaacaggggcatcaggagttgaaagagtgggccagtgtggactcgagctctagctgctcagcctcaggctaaggagctgtgcagatcacagatctgaggtgaccactgtgtccctagtgaacaagatgccactctgtactgtcccttaaggggcctagaaaatgagctgagactacaaaagttggttaatcaacaccagaccttgatgttggaagagagaaatggtagaacactgtgccacacttggccaacaggatgtgtctgccatcctttgggaagattaagtagacattaatagaagaccagtgtatatacacataactcagagatagtgcacgttttgttctagactaccacaataaagtgagacacatgaaatttttggtttcccagtatgcatacaagttacgtttacactgtattatattagtctgtgatagcattatatcagaaaaacaatgtgcatacctgaatttaaaaatactttattgctaaaaatgctttcagcatgagcttcagcaagtcactttctgctggtggaggttcttgcctccatgttgatggaagctgaatcatctgggtggtagttgctgaaggttggggtggctatggcaatttattaaaataagacaacaaagtttgctgcattgattgactcttcctttcacataagatttctctgtagtatgcaatgctatttgatagcattttacctacagaaaaacttttcaaaattggaattcaatcctctcaaatcttgccactgctttatcaactaagtttgtaggaaattataagtctttgttgacatctcaacaatgttcatagcatcttcatgggaaatagattccatgtcaataaaccattttctttgctcatccataagaagcagctcctcatctgttcaagtttgataattatattgcaacaatccagtcacatcttcagactccacttctaattctagttctcttgctatttctaccacatctgcagttacttcttcccctgaaatcttgaacccctcaaagacatttataagagatgaaatcaatttcttttaagactattttgccctcctcccatgatatattgacttatttccatgaatcatgattgttcttaatggcatctagaattatgaattttttctagaatgttttcaatgtacttttcccagatccatcagagaagtcactatgtatgggagctatagccttatgaaatatacttttgtaataatcagatttgaaagtcaaaatcactccttgatccatgggttgcagaatggatactgtgttagcagatacaaaaacagcattaatcactttgtacacttccatcagagctcttgagtgaccaggtacattgtcaatgagcagtcatactttgaaagaaacctttttttctgggcagtaggtttcaatagtgggcttaaagtgtttagtaaacaacactgtaagcagatgtgctgtcatctggctttgttattccatttatagagcacaggcagaggagatttagcataattcttaagggccctatgattttcagaatggtcaatgagcatacgctttcacttaaagtcacaagccgcattagcccctaacaagaagatcagcttgtcctttgaagctctgaagccaggtattgacttttcctcatagattaaaaaaaaaaaaaaaaaaaaaaaaaaaagtcctagatggaatcttcttctacattgaaaatctaatgtttagtgtatccaccttgatcaatgctcctggctaggtcttctggaaaacttgctgaagtttgtacatcagcacttgctgcttcaccttgtgcttttctgttatgtagatgacttctttacttaaacctcacgaagtaacttctgctagttattttcttcggcagcttcctcacctcgatcagccctcaagaaactggagggaattagggtctttctctttattaggctttggcttaagggaacattgtggctcgtttgatcttctatgcagaccactcagacttcctccatatcagcagtaagcatggttcgcttgcttatcatttgcctgttccttggagtagcacttttaattttcaagaattttccctttgcatctacagcttggctctctgtttggcgcaagaggcctacctttcagcctacatcagctttccatgtgccttcctcattaagcttcatcttttctggttttttatttaaagtgagagatatatgattcttcctttcacttgaacatttagaggtcattgtagggttattaattggccaaattccaatattattgtggctcagggactaggaaagcctgaaaaaagggaaagcaatgggggaacagcaggttgctgaagcagtcagaacacacacaaaatttctcaaccagagatagggttcgtagtgcccccaaacaattacaacagtaacatcaaagactcctgaaaacagatcactgtaacagattttacagtaaagaagtttgaagtattgtgagaattaacaaaatgtgaaatcaaaacactgagtgagcacatgccattagaaaattggcactgatagacttgcttgatgtagggttgccacagctcttcaatttgtaaaaaatgcaaaaactgcaaagtacaataaaacaaggcatgcctgtagcatatgaaagagctgcactcaagtttccccccattttttgagaggaaaacttattttgctatatcttggccttctgtatgtaaagaagttctaaggtatgttagaaaatcccacatcttgtaaatgtcttatttaaaaagaggaagaaagaagaaatcataggaaagaaatgtcttctgaaaatgacttttggatatggaattgtgagaccatctctagaagtgacaccaagagacacacaagtccatgttcactcactgggttttagaggagatggaaaagtccacaaaaatgaatagaatcgttctctataagcctatgccaagctggtcacattttgaagatattttcttattatactcattgttctgtgtatgcattttattcctaataagtgtacaaatagttaacaatgttaagtacttttctgaaatactgagtctttatagacgttccggagtgccttatacatgtttaaggtagtaataaaagagcacattttatgaataaccttgataaaattcatacgacatttgtcttttggaaatgaaataatcaaatcacctttctgagcagtatacattgtatgtgtgcactggttcagggaacaaggcagaagaaagaagaggaaaaggctccatgccagtcattttatagtaagccaagattagccatcttatcctgaatgttctgtgcattttattttactttgttctctatgtggtatacataatgaacaaatgagtcaattttacaacatcttgtctttctagttgttaaagagcctgccaatatatgaccaaagtagagtttgtaaactattttgtacattttgcgttatatggtaaagactgtcttctgaaaacaacttgagaatatgaaattaaatccatctctaagaattatagatacttgtacacatagtaaatactagaactgttaaattaaaagcaaagtgttcagtaaaagagacaactttgtggttgatcataaactaaaatacttttaatatatatgattcataagatgtcttacgtttgccggttctaaacatcctttatattttatcatttgcatgaagaatgtgcagatattgccagcccacacccagggaccctcacagagtaaacttgtgtatgtctataagtgatctgggtgtttggcttgtgtcttggcatgaaagctactcctgctcttgatctttgcatgtgcataggatggaaggaagggaagggactctgctgttctcaggagaacttcaactctatgtctttatttttgaggatgagcaaactcttcaaagggctgttctgccctatctcttattttctgctttcctaacctttccccatttcctcttcattctgaagtgctaagaacgtttgagaagctggaggacacatgcttagaaccatagggaaaaagccattcacattccattgtgtcatcagcccagacctctttgtcttacccagaggccacttcccaccaccaaaaggaatattaggagtattaattctttccgctactaagacgttgtttagggtaccctaaatagcagtcatcgaaataaatgaagcctctattttaaagttaaagggacactagcactttaagctgtttggtacagtgtttttaaagtatggaaaataacactcaccttcttttgagaccatgttaacatttttgaaactgtgcattattcttttcagtagataatacatttaaggtcagaactatgctagaatatccagattccctgcagttggtgttctgccactgaaacctcaaaaccagatactctcagcagtgtactgcatatattacacaggtgcatcaaagatttatcactcctcttggtccacctccgggcagcatttcatcatcgaagaaaataaactcatttgagccgctctttaatttttaaaatgaaaatctatatccatcaggcatatgtcatagtttcagagtaagaaaaagaagataacttttgtgaaatgtctttttttcctataaacacaattacaaagcactcaacttataaataacatttattttatattaataaaaagaatttagcaaattcccagtattatgctaggtgttcatactctctactccagtttaaaacacacacctgcgcatacatacacacacatacagttttaaagatgcatttttcctcttctggaatgtgttactattgcttcacctttgataactttcattggggagcacttttcaacttaacttgtgtctgcacagtacattcaatgtggctttctgatgaaattgacaggtcaattcaaaaacaaccatattcattgcaatttttttctattccgaacatgaccaaatccaccaagcatattagtttcccttaaaactaaagaactttttaaaatttaggcttgagagaagcgaaacttattttaataactgaaggaaaaaacggttgatgcttataaactgtgtatcagattttggcctacgtgttccatatctatattatctaatttaactctcacacacccttaagatagtaggtactaatattaattcctgcctgtgtaacctaccattcagagagtaaaataacttccctaaagttacctgaacccaggaaatctagctccaaaatcaaatgaccaatccctatcctatacaacctctcaagaatgagcacatgtagaggagaataagcagaaaatatcattagttcaaattaactggatgtaattgagggtgaataagccaaaaatgtgaatctctaagtacctggctttaccttttctagagttttctttgtcttgagccatattctatgttcaggctctcaacatggcaacctattgggctgagacagatagaaaatgcatccatgatctcaaaaagtaattggcctcacctatcccgaatgcataaaaagtctgctaattatgacagaattatgtggacattcaattgttttttaaattttatattctaagtcaatattttgtaaatattttagaattagtaagtagtgttattcttaatgggttacccctgccatgaatattaggaaaaatatatataaatgtaaaatttgcctgcatacatttttgtttctgaagaagtgttagtcactttcattctttaaatatcatttgtgttgtcaaattcccatgttttttagctttgccctctttcctgagtttcttctctaactgcctgatggaattcttcacctggatacccatcatgctttcagaatcaacattcctgcagcctctaaatcattttggattaaatgcattctcaatgattataaaggaggtgcatgactggggtaaaataaaactttttaaataataaattttctgacacaagttcagatgtgacttatataagtcattgaatcctaatttcagtcatcaaatatggaattcatccagtctactagcttcattttacaaacgaagaggctcagatcctgacagaaactgtgacttgttccagatcatcatgaatttgtacctggactgcaactagaatctttaatcctgatttttttaaataataatgatggctgttatttttccactgggcataccatgactcagatgccatactgacattttactttcattatctcatttaatcctcaacacgaccctgtaagtaagcatttttattcccatattacaattgaggaaagggaagctatgggaggtgaacctattcattaaggttcacaaagctagaagagtcagaatcccaaaccatgtctgtctcactccaaattcccttgcttcagtaagcttctctaggccaatgttccttctgcattgcccattttcttcctatgaatgcaaattacataaacatggaagtacatttgaccattttaattgtttaacagtccatgttgcaggaccttccacaatagaatcaatgtattaaaatgtgtaaatgaccacactttttacacaaatgctatgaatccttaaggttttccaatttataaaatatgtctgcaaagcatactttatgatgctttgtattctgtcagtaattggatgtcatatatttaaattctattaaactgcttattaaaatgtccagtgcctcttttcttgcatggccacaaatattgtcactataaatcagcacctttcaaagttagtttcatgacaactcaagatacttcaaactaatttagaaagtctcaaaataattcaaaaataattcatttagttaacatattttgtaaatatacatattctatatattaacttgaatgtggaataagtcaaggaagagatatcaaatgtctttaaaaggtattacaactgtaagtaatcaaagaaggaaaaaaaaaaacaaacagaataaactgttaaagggccagaatactaggaagaacttaaataggtagtaagcaatacatacttcctcacctatataatatcaaagagtttgggatacccacagaagggactgtgaaaacctcttagaccatcctccgcattggtgtctccttaaatcaatgggataaatactgaaaatcttgtccaatagcaatccaatttaagaagtcaccataggtatgaatagcaaacaattatatgttccccatcatggctaaatgtatcttgtgagccatctacaaaatcaattattcagcaattcagttcatttcattgagacaatattaataaaaggatcaaaagaactatcgtctaattatgtcatacacaataaatcaccaactatttatcaaaaactgttctttccattctacctctgtggttattgccttaggtcagacaccatcacttctcacctgaattaatgtattaagtttttaatgggtctccctatctccaatctcaccaatcccagattaccctttaatgatttcacattaccttgaaaataactaggcacttatttttgtgctctggtacaaaaatgcctttgtctgttgccacacaggccattatctcatggaaaacctgttttccagctgtgtcgaattcagtagtattcatagacccaacacaatctcttcttgtctttaatgtgacgtttatcctgaaaagagtgcttttctctcacactccctgtatatctggttggcttatccttgaatatcctactcaaactttaccttccccaagcacagctttccatgatctcctcaatgctgagctgcccttctctgtgctccttttgcaacagctgccaagccatttcttacatggcatttactgtctcctctcccagaacaatttcttgaggctagaaaccatgtcttaattatcttgtggcctagtatctgaatgtctgcaatatggaaaaaacgctccattggtgtttgttgaaaggatgaataaataaacatttcctaaaattgcctgatactaagaatcgctcaggtgctaattaaaaattcagatccccaagctaagatttatattgaccagtatgaattgaggcagaagattctgtacatttatcaagtatcccaaatgattttcataatgaggaaactgagagaatttaatcataacggataggaaaatctgtctttgcatgaaatttctctgtcctctgtctacgggttacttgtttttgaggtatccatgaggatactcctccccctttatctgatacctaactgtgctgtgcaagaaaaacaaaacagtttttcgtcatataagggcatgaggctaatctatccttagctcagaatataaactcagcaagggacttagatatgatttcaacattgtttgtattctttcagctagcgttttcaatgtggcctaaaaatgtcatgactcagagtacttattcgtagaattgcttcaaaattttatctaaaccactaaaatttcacacctggcattgaaactacctagtttgcctgcaagaactccacttacttgggaaatatacagtacttgctgagactaacttactgtgtaatgctttatcctataactctaggaatacaaactctttaaaaaaaaaaaaggctgttccatgttgcctctattcagcataccttactcctaatttcctgcaatattcttttcacctctactactcagggcaaactttttttctcaaagtcacaaagaagctctgaattaccaaatctaacaaatttttttcccatacccattggcttctaactaacagtatgagacaagcctttcttcaatgcccattccttgttggattcctggccttcctctttctctctctgcaactttttggtctccttcataaacgtattcttttgttttgcctgcttctaaatatgtttgttctattttggaatctaaacttgttggcctagcagtaaagttcttcaaagtttgccaatctgtttggatcttatcacactaaacacctctccatgtatcctacggtttgagctggcactcgtcagatgtggttttaaaatgtatactaattaaaattaaatagaataaaaaattcaactcctcagtcacactatccacatgtcaagtgttcaacagccactagtggctaccatattggacagaacgttcatacaacattgccttcatggacataagttctattggacagtgctagtctagacaactggactactcaaatttctcatctctacactttagctcattctattctctgtctacctgaaatgcggtccaccaaccatatctcttcctattcagatatgacttgttcttcaagatttattcttaatatttacctgtctccaaagtctttacttatcactctagctgaaagtatggcagcccacctatgaactctcaaagttgtttatactactgctcttccccatgttgttttgttctgtcattattggtgcaaatgcctgctttccttgatcagagatataatctttgaagagttgattgatagttgccaactgtcattgagcactttgaacatgagaagttaagtgcttgatcatacttctcacatcctcataactcccctgtgaaatatatgatgttttttcatattcacgttaaagaaactgggatttacaatgatgaaacattggacaaattaaggtctcaggacaggaggtcacggagtgatgagccctgaattactctaggtgggtttaactccaaagcccatgcccttacccaggggaacacactgcttcttgagatctcattcaccatgttaatgaccaccccacagccccaccacctaacgctaggcatgctccatttgtgaatgagtgaatagatgactaatactttatatgcttatggtcatttacaattcacaaaacttgttgacagccatacttgatttccatatgatttccccaacatctctgaggcagctccataggaaatgttatctccatttcacagaggctgagagagttcagagtcctccagaagctcacattgctatttagtaacaggcatagacaggacttcagcctgtgtgttctgccttcaagttctgccagcctttcttcaaaaccttctgtgagtttaaaactcatcaacaatcagcaaaggcttaaagagttgttgtatcttaatatatcgtcgtcttcttcttttttttttttttttttgagacagagtcttgctctgtcgcacaggctggagtgcagtggcaccgtctcagctcactgcaacctccacttcccgggttcaagcgattctccagcctcagcctcccaaatagctgggattatgggcacccgccatcatgcctggctaatttatttgtgcttttagcagagatgggatagggtttcaccatgttggtcaggctgttcccgaactcctgacctcaaattatccacccattttggcctcccaaagtgctgggattacaggcatgagccactgcacccagccttgagatactgtcttctaaaacttgccctttttattgtttaaaaaacatgatgaggccgggcacggtggctcacgcctgtaatcccagcactttgggaggtggaggcaggtcgatcacctgaggtcaggagttcgagaccagcctgcccaatatggggaaaccccgtctctactaaaaatacaaaaattagccaggcacagtggcgggcccctgtaatctcagctactcgggaggctgaggcaggagaattgcttgaactcagaaggtggaggttgcagtgagccaagacggcgccattgcactccagcctgggccacagagtagtgagactctgtcttggggtggggtcgggggagggggcagggaggaagaaaaaaaaaaaacatgatgaggcttaatggtttatgtctaagggaggggaagaggcaatttattcaagttttcagtgcttttaaatagccacatatttcaatctttatcatattgtttttgccctaaccctattaggataacttgcttacattaagcaaaattctgagaatgttaattagcaatttagctatgaatatgcatgattatttttaagtccactaatattatgcataggtcttatctgtaattatatctaaatgttctcttttttctctccctctctctttctccttcaggaaagccatttaaaacacatttgggaaatgtttgaaaaaattaattctattacccttatttccagaattttcttaaatattttatggctatattttttccttctcaaggcaaagccgtacatcaccacatacattatcatatttgtttacaaaatatgagagtcaaggaattaattttacaccagttaaataacagaagaaaaagttatactgtattttcttctttattatactaattttttcacatccttaaatggttttatattttgtggctatctgaaattatatttaagggcgagtattatactaccatttgtttcacatccaacttggagcattgcatatttgtgtagacatataaggttagtcaggggtgagagataggaggattaaactcatctagtttgcgtgccctttctcagtcacaatgcagtctttacaaacaattttttcctttaacagaaaaactgaaaaggtgtctaaaaaaataatttgccttaagacaacctttctaggaaatggtgaagatctgtttcaaacccaggcctgcctcatgccaaagcctatgaccttttcactattaatgaccaaatggttgaatgactgttaaataagtctcttgggtaaaacataaacgtgcctgatacccattcattaaaatgtttattagatgaataaataaattggtggatggagctcaatataatcagctcatgtgcctccacaccaaaagagaacattttcaaatgaacatgcaggaggaatacatgattacaaaaatgcttcagcaatgatttcgcttttataggattacttgtcccaagttcaacagtcttaatgcacatgcaatttgcttgaagtctataatgcccttggatttcaagctgaggagtctgatcatctggaaactaaaaattaaggatctgaaatattgttaactaaatagattgaactaaaattagcctcttaggacttaaagtgcttccacataaagtccaagagctagaaatgagaatgatgttctctacaatcaaatattgccttaattccaaatttagcttctgccacttgatctaatgttacatcaaggcatatgggccctctgcatgtgaagagcttacaccaatttaaagcaaatgcatcacatgggcaagaatgcaaattccaatagtaataatgtttctttcactatttatttcattccttatttttcatacttgttgccactttgtgaacttgcctccaatcactttacactggcttattttaaaagccttttaactgttctccttactgtcacccttttttcctaattccactgttcctacaaatggttgctagaaaaatcttccccaaacacagcttttatcacaggctcaaaaacctatcacaattctctaatgcctggtctataagactcttaaagtctttcccccttctcaccagcctagtctttccctgaggcagattccctattaagaagaaacaatattttgctatgccctgtattttcttatctgtgccttttggcatgctagtgctagtgatcctaatgtagagctttcaaacatgctttgaaaattatctttgatatattttcatatggcctctgtattagtcagggtcccagaaaaaaaaatagaattcatcccagagtgttcaaataaagagattttaataaaggagttatttgcataaattgtagacagacttaaggagcaaacaagatggcagggcacccaaaggatagcaatggtgagaatataatactacccttagggataaacagtcaaggaaaaggagcagtgtttccttaggagccctgcatcagaagaggtacagaggagaacagggtgaagggagttatatcctgaaaggacatgatcacggccagcgcacaggaccgaagtaggacatgaagaagaaatatcctgacctctttctcttcctgccctccaatatcctgctagagccttccataggccccacccaagataaacacagagagcagagagtcccagtcatgcaaatgacaagggtcagcttcgcagagcacagggaagacatggaatagtgttgagtgcatgggggcatggcaaatggagaacaatttgcacagtctgagctactctgtagccttctggaggatggcaatttctgagatatcccacatttggagtaagagaacagccacagacctcactctatgtgtcactttgagcaactttgcttagttagaagctatttccttacctttaatataagagtaatactcagtttgtataatagtcctggacatccaatgaaaaactgtgtataaaatatcttgtcccataagtgctaaatgaattgtaactactgctgtgactgactaaataaaaattatatatgtataagtataaaacctcttacaaaacatgtaataataaaagaatgagtcataaaagacaagaatcaatgagtgttaatggtcacctttgttgctgacctctaaactccatcccctggccttaacaaatatggcaggacatcttcaggatttggcaggcagacaattttatcttacactagtgacttggatgccattcctcttccttccactcagtaacagacggtgccctggacagcagtgacatctgcagccccaagggagaagggtcagcacaaattttaattttgcttttggtttggggctttaagtacacaaacaggttttttttttccctgtcagtttgcatctagcttcgcatctgacattttttaatgttttatgtatttggattgacctagaaatttatagcttcaggtttttgcttattttgctctgtctctaattcaacctccttgatttaaaaataaaagccaaaatataacatgaacaaatactctatttgtctgtatcactaagggggtaaggaagaggtcattctgctctttttgagctacttcttattacaatatattaacatttgaatatcttcaataacaagaaacaagaatactagggataacctataaaaacctgagtataatttgactcatcgctaaaaaaaacttaaaagctaagaggagaacatttacaaaaattgttatgttcactgacaaggcattagatttcagactaattgctgctatgagaaaaatagatagatacacacatacataaagctttatttttagaaggtcaagtatctacaccaaatgtttcatcctccagagttcagtttcagggaaatctctacaataggagagcctcctgatgtttgttgtggccacatttggagccatcaaaatttcctactcaggcatcccacagagaaaaagcatctacccctaagaatgtgaaatagtatcctcattactgagttgattactcatcaaccttaatagtatttgtaattcgcctttaccctggggcagttttcaaaggtcacagggaaggctgaaggctgtgtctataagacagtttgatcaaaatagaactaaaggctggcctcaggtagctatttctgagttggtcagaggacaatgaaaactacagttcatgcccaaatgttctccttggtcaaggggagactggctagacagagtcagatcttaagggtcatttctgattggcctccatccagagtatgacaacaaaactcgagaagcttcgcagataaataatgatgtaactaatttaggtgtttagataaatcattccaagtctcttttgtctgcttaggcctgattttcctgggctaggtaaacaccctgaatttacaagagaatgttcagcctcattttaactatgcaactggtagaagaagaagaaataggccttcttctattttgatgctagaaagacaaataaaacgacatgcataagtcatttagagtagtaaagcaaataatcaacaattcacaggattgaattgtatgataagaagacatatggaatttctcattctggttcttttctttgtcccttttgtaagttacttactcaaattgattacagcttttcaatctgtaaaaaagggatataagataaataatctctaatattccttctaactctataaaaatagctattgttttatgtatcaagaataatcaaagtattttttttagattgcagacctatgttctcatgagactgcatttcagatggattggaagcaacctaatatgtattcaaaaaccagcaccagatgaaaggactcagccagaatcatgcaaagcagaagaatcaaattcacagagacagactaaactttttaactaagactatcatgcaattatattgttggtatatcccatgtctattggttgtatatgtatccaaaaattaggtttagagatggatgatacacagattagataaactgataatcaatgaagaaatggaaaaatagacatttttaagcacattttctgaaatatcagatgtataaaatatgtgtattcatgaaagaaataaaattagacaggagacaaaacagataatttagcaagaagttattaagggtgaataatagtattcagatctatctgtcataaggccctacaaatactaaaattagctgtgatttttttctattagttccctaggattctgctaaaatcagcatcctcatgagcactggttaacactatggtgtaaatcatttgctgatgccataaattaaaaacaaaacaaaaaactatattcaaagtaactgagctataggaacatctccttaaaagatggaggcattaagagcattttccacaaccgagaactaaatgtcattcacctgtgaattaaaaaaaggaaatcacgggggaaaaatgagcagccagatcaattgcataaacctttgtcaaagatagaaatgtttatatgggagttctgtggctaaacaaaatgcaaacagccacatattttttcaaccaacaaatggatatcagtagcttaaataaactctttcatctttttatttttttcatccttatccttgctttaaaaaaatggaacacagtatttgttgaagattttatgcacatattgcatcatagcccaatttctcaaactcaaagtcaatttagcaaatagaaatgatagcagaaaaaacatataatgtcctgttgggaagaactgtctttcattgtagtgtgaacttaatgactgcatcacctaccttgaagtattttttaggtctagttattcatttaacaaaggattatccagtgccttctatgtgacaggcacagtggccacaaagataagcaaaaagatatgctccttatcttcatggagcttacaatttaataagagataaatatgcatcaaacaaccccacaaataaatgtacaactgtaactgtaataaaagctaaaatgagtatggtgcactatgggcatacagtagggagatctgacctaatcagagagttaagacaagttaggggccttgtatcctattcctggaatcttgctcatcagcaaacagctgaaggaagtatttgtaaggatagtatatccctctgtacatcccaaagtcctgtcctgtgcacagccactgactacatacctctgcatccaaagcagactcagctttcagctggccttgctgagagtgagcccagcatatcttggaaaatgaattcaccacactctggcacaaaccccatatcatccaacagcttcttcaaccagagcagctcagtcttggtccttatccatgaatgatggttgcagaaccacgctggctttacagggatctgggtaggatccattgcccccaccctgagtgtattcatagtgatgtgctatatggtttagaagccttggtaaataagtcaaggtagaactgtctcaacccagaactttcttcaggtaagaagtatgcttccaacagaagttcctaacaggaagcagctatcaccatcaaaggggagtactgaaatcattccaagactaacccccacagtctactcttttcttccctatcatctgtgcccctaaagcagtcaggagagttccctagccagacctaactcagtacttaaatatctttgataggcctgggaaacagaacacaggaagaaaagtcgtggcttttcaccccagcagtggaatctattcttgttttttgtagcatgagatgtttacacctaaggaacagaaagtgaacttaaaatgtctttaattaagaaattaggtttaaatgattccatataacaaatctgatttaattttaaatttttgaatacatttactcattcaagaatggtttcaaaccctccaggggtgagataaatggcaattctagctatcttctaccttcaaatataactttcctgaaataaaaacaggaaatccaatttgtaatcacaataaagtttcttatctaaatccaaaggccagtttttttccccttggaaacataagcgcctgaagcaggggctgcattttgatattctttgtggcacttggcacagtataatttctatgaaggtgccttgtaagtagcctggggtgattatggtggtgtaattttcatcacaaccacagataacccaggtaactgtgcaggtacaatgacgttcagcttaagtggctttgttccaaacaagggcctctattgtaaaaacaaagcaggtgttaaaacatagagatattgaagataggggtcattttacatactaacatgcactgaaaagtaaatctgagcttccccacattattgccaggaattacggtatacttaagatgaatccattaagtacacaactggacaaatgatgaaatttcatgttagcaaaattcctgacatatttcacacctcttactctattaaattacacttttttaacaaagaaaagctttcctactgctacacattttcaattttttctcctatgtatttcatattaaaatttcaaaataatttgatcagagatctagtgcacaaaggtgcctaagtgaacaataatcaccaaaaacacttgcaatggctgcagtagtgggattcccatcagtgatgtcaacagtgatgccaagaagacaaaagaagagggaaggagctaataacaaaatccatagaaaacaggcttcattaatttctgaacaggctacataaatccattaatgcctacagattaataacatggtcatataaatgaagttactgcctacgtgttttctgaaaaacatcattgctaattcatcttatactgtcaaaatttctttatccaaaatgtatatatttttgagtaatatcttctcaagaaagtaatactttcttgtaatactcaagaaataccctcaattcccaagtactacagtttatatgtgaccagtttttgatataataaaatatataaaatgtaaagttaaaccttagatgtctatctagtgcttattctgagtggcaatgaaataatgtaatagaacacagcaaaaggccgaaagaaggaagagctgtattttgggagtgcagagaagtattacttcagaaatgtgtccagacaaagaaaactcattcaagggacgtggataagggccaggtggactaaggaagaggtaatctatctgggtgtctcaaaaaggaagttttcattctggaatctgaaaagaggatgaatgcacctgaaaatcaaaccagcagagagtgtttcaagaagtagagttagagagaaagaatcaactagagataggtacatcagacataggaaaggaaacgtgtagctaactgatagcttccataaagacaaattgaataataagactgtgtatggtttacaaatgcaggcagtatttttctcgaggtgtctttgtagtgaatctactatctttatatttgccatgttaaagatactactgagctgcccagagagcagtcaaggaaaaagatttttggccacagggctgtggtccttgagaaatcctggagttcctgtgtgcttaggaagttatcagaaacagaacatgttgtgagtgtctgtgcttgaagtgaaagaagggagatattgagaacagcaatgagtttgcccctttttgacaaatcttactctctgcttatttatatcaaattatcatcatcatcacccttatctccagtgattacccaagtctcttgttcacactcctccaaactgtctacatatacctccccctcgcaatacacactgaagttattaagaattgaaagaacaaattgtttgcccatcctcataatcatctgtcctaaaaggtcatttaaacatttaatcaaacctgcagttctccaggggaacgtgtgagtcatgccgttcatcccacacactcaagcggggctttgtgtcagtcttaggaatgatgcagactggtcccacaaagaaatcagtcacagggacattttctgtcattaggcagagaacaaaaagctaacagtttcctggactctactgaaataaacttttgcaccaattaatgaaacccctatggaaagcatcatgccagaatccaaggaggctgtccatgtattgacatgcaaactaacactcctgcaaaagagggggtaggtgagcatcctaagtcaatatgaattatttgtttttctgctactttggatcagctataccactgctccctttcacaggtacaaatacacaaaagagggcttctgtttcataaaagtggctctgacaaatgacactcctcagggtgctgaacccaacactggcagccagcccattctgtgccctcagcctgccagtacttttcacttccaaagctatcagcctgcttcagacctatgccttcactctgactagggacaaagaaaagatcacagtggaaatccttctgcgtgctgctaataagcctatttagagtcaatgagaaagcctcattttgcaccaccaataaaggccttcaagagtactactgaatcagagaaaccgaaatgtttctatgtactccctgtcctcattttacatcagcctgacaggtgacactcagcaaaatatcgaacaggatgacctccaagtttccttccttctctaatgtcctctggttctctgttggccagtaggatttaaattttatttaaattatctcatattctgatggattcttgagccccttttcagttttagataatctccctgtggtttgctgaattggcatatctggagtctaggatctctgttggcaaagaactgaatattgctcccatccaacagcttagctagcactgtctattttctttctgaaagagatctgggtaggagacaggtgcagagcatctttccacctcccacagaagggctagggaaagctttgttgtgcatgaaccatgaacaaaaggataattcaaaccagcaataatgtccttaataaaaaataataatcattttcccaaatgaaaatctacaattctaaccatttgatcacagtgatgtaagcaaacaagcctgcagctaaaggttatatatgggtcaaagatttaatggaaagtgatacatgggtggaatgacatcacctatttgtcagaatactaactcctctaccatatcctatgtcggcccaccgttggggtgtaagggaaaggtgcataaagagataagtacccatttctaaacataatgcaagtttgacatttaagctcaatagtttagctatagagcgttttggtaacataaaaagaaaccagagcaatttgagtgacctttgtgaaagacaggcataaaggttgcaaccaccactctcaccaccaaaatctaaaaatgcggaaaataagcatttatcaaaatttctcagagactatgttacccacccaagattccacagctaggatgcagtgtttgagtgtctactaacaaggctgggaattattaaacacagaaagcataacagaaacacttagttcctcttgggtcttatggtccagttgataaaacttccagcactttgaacagattttcacttactgcaaagaaaaatgcttagctgaattattgtctatctgggttgcaagtagcacacccccaccatctgtaaaataatattttggtagactagagggcatgttgttaaaggaacccaaaggagaattgttttgataaagttagggacaatctctaatatgtgtgttttataattctgcaacttatgtagaaatatatctgaatgaaatgttgttgaaaagctgtatatcattttaattttaataaatcaaatcacattttatattcactgactgagaagctggtacttaggaaacctgtgagaaattagtttaataatttgtgtgtattgcaaatattgaccttctgacttaattcagaatttctatataaaaacaaaaatttaattctttaatatcttaaaatgagggatgctcatgccatgttaaataaatcatttccacttatatttaatacattgtattagttaggatgcttgcagctgcaaatgatagaaaatccgatccaaaatggctttaaaaattgttgttctataggtctatcaccctagacttctgctgtccaatatgatagtcattagccacatttaaatgtaaagaaatcaaagttacatttacatttaagtgtaaagtaattaaagttaaatacaatttgaaattctattttttcagtttgcactagccatattccatcaagtgaccaatagccacatgtcactaatggctgctctattaaacaatgcagatatggaaaaaccttcttcacctcagaaagttctattagatagtgctggcttcaaagaaaaggaagttgttaaatcagtaagcaacagtatctgttatattccctatgtagcaggcaataatctttatgcatattatttcctttaacttcccaaccgctctatgaggcaagtattattttaatgtattagtctggactctaggttgctagctaaaaatgggaaaacataattaggagaaccttgaactatctcacatatctacaagaaaagcctggttaaggtcctcatcaccatcagaactctttccatctgtcacctttattctgttgcacaagtcaatattattcttccaggtcagcttcccccttgtggtggaaacttcccagcctcatatctcacagcctcaaactactgcctcccaccccctgagagagaataatcttcctcctttcactcccattttagatattactcggaaggactctgataatttagctttagtgaagagctcagtgttaaatcaatcagttgtggctgaagagacacaaaggagaggatcagggttgtagaatagagacatggccagaggggctccacttatggacagtgaaaacaatttctacagaaactggaatggcagggtcctctccttcaacatatttctgagtcctcaaggctctatctcaggccctctgcaatttccactccacatactttctggatctgtctcaccaagtcccattaatatactagtgaggccccaattctctgtctcagcaagaccttgtattcttagcttcagactcacataaccaagtaacccttcccagacatctgcagctctatatctcataggatccttaaactcagtatctcccacaaaattcatcatcctccttccccctcttccccaatcattcattatatcaggaatgctctttcaatcaatgaccgaatttcccattccaagaatcaaggcatcatccatgatttgtcctctcctttaacatgcaattaattgccaagccctacatatatccctaaaatgtctttttattaatatatccatctacttctgtccattcctagtacagtgcaaccatcataggctgggccactatcatttctggaaaattactgtagtatctcatgggtctcccttcctccagtgttatgcctcaccaatacattatccatactacagccagaataatctttctaagatggtgattctattattctgcttaaaaccttctggtgcccattcattgactttcaaaacatttttcaactgcctcttgaggcatataaagtgttatatgatctgtcccttgcctaggtctctatccttactctcttcctatccccctctcctagtctctacaactgccatcctttctcttgcccactggtctttgtgccaccctctggttaaaataataatactactgataatctctttttcttaattctgctcatattttagtctcaacttcaatgacaccaatcttctcccctaggctacatcagttctccctgctatatgctggctattcgcttaacacattgcattgcaggaactgggctaaattattcaccttcccaattagactgtaagccccatgaggacaataaccatttttgttttgctcacgaacatgtccttgacatctaatagctagtgcttgaaaaagagcagaaaataagctgaatttaattctttcatttaatccacaaatattttaaggaagcctatttgtgccagatgccacccaaggcactgagattcagctgtgaatgaaacaaaatctcttcctatatgaagctcatgttcttgcagggtaaaaaaaaaaaaaaaaaaaaaaccctaataaactaataattttttagaaaatgcttaaattgtataaataaatatagttttaatatttgtataactttttacatttttatttttactttttaaattttattattattatactttaagtttcagggtacatgtgcacaatgtgcaggttatttacatatgtatacatgtgccatgctggtgtgctgcacccattaactcgtcatttagcattaggtatatctcctaatgctatccctccccaaaccccacaacggtccccagagtgtgatgttccccttcctgtgtccatgtgttctcattgttcaattcccacctatgagtgagaacacgcggtgtttggttttttgttcctgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacatgtgcgtgtgtctttacagcagcatgatttatagtcctttgggtatatacccagtaatgggttggctgggtcaaatggtatttctagttctagatccctgaggaatcaccacactgacttccacaatggttgaagtagtttacagtcccaccaacagtgtaaaagtgttcctatttctccacatcctctccagcacctgttgtttcctgactttttaatgactgccattctaactggtgtgagatgttatctcattgtggttttgatttgcatttctctgatggccagtgatggtgagcattttttcatgtgttttttggctgcataaatgtcttcttttgagaagtgtctgttcaaacaaatttacaagaaaaaaacaaccccatcaaaagtgggcaaaggacatgaactttttacatttttaaaattgtataaatgaaacctttttaaatgacattttccattatgtactccaagttgtcttttcattattctgttacctcattagaggtagtatggaaataaagtgctttcccctcaaatagtataaatgtaattttatttttttagaaaaacaaaacactatggagtcatggcatttataatgaagtaatcaaatattccaattaaatattcaggtaaccaaatattccagttaaatattcaggtaaccaaatactccaataaaatttgactgattttataggacacaggactatatgtgtttctagaatcatattcccatttaaattagcatcgcagtcaggaatttaaagacaaactatcagaatagtacattttcttcttaaattacagtaaaagcccttttataactatgttgagcttttccttttattaaaaaatatcattccaacaattaaaatatttatcaaatgcatgccaagctaggcaccatgcatcatatctacatcactgtaatgaagaacaggaggactatctggccatacattatagaccaattaattaacttaacagatatataatgctaagcatatgctaagtcctgaggatacagaccctgcttactagcaacttacaaactattgtctgactattatcttcctcacaaaatataagctccttgagggcagatgtttagcacaatatagagtttaacaaatgtcataagtaataaaaaaaaatcaagactcttcggtagtcttgatttctcaattagccttagtaagctctaatcacacttagtcttaatttctcaattagccttagtaagctctaatcacactttatgtctcctttgccctactgtatccaatcctttgttcagctagttcttttgtttagctatgttcctaagaagttgtggtaattctcttgtatttcagcaaatcatatctatgagactctctcaaatcctctgagttaaaaagaatcccaagataaaacatagagaagaaatattatttttgaaatatagtctcctgtatttatctgctttgtatcacttttagaaaagaggagaaatcaagttttcctgatattgaatcatctatacattgttcctttttaaaagtttgtttggttttaatgaattggttccctcaactgaagtttaatagccatttaaaggaagacaatttatcctaatgtttctgtatttttctaaactttctcatcctctctggcccaagccttaccatagtttttcaaataattggtgatcaaaaatgctgaactgtcacctgtttgcctatatactcttttccatttgtgagttcttcagtgtaatattccagagattgtgtttattcagatacattcatcttccaatcaatcaagataatgccagcttctgttgtgggttttgcagaaaggatttcctagactcctgaattcattttttctctctgtagtgtgagcatttttctgttttaaattattttctgaaaaaatgtgagtatttacgtactcgaaattttaactagaattgcttcccttctaaaaatgttagtttctcagaccaaatgcatcaatctgactccctcagaagtcaggcggttcacaaagagggaatacttcaccttaggtggccaagaaaaaaaacatactggcccatataccaggaaaaatagtagaatgggtcagtgcaactcagccccacttcggtaaagttcttcagagcaggaaaggatgaaggaaagaagcaagtatcaaatcagacttcagtcctatcatcgttaggtagctacagggctttagacaaccaacttgaccagatgagcctcaatttccctttctgcaaagtgaggaaactgagctaaataatctctaaggacctcttcaactcctccactctatgtgtatttacgattgacagtacagttttctaagtgttcagaatattttttgtttctgagatggcaaactttacaatctgctttgcagactttgaagatacaggtgcatctgtgtacgtttctttaaatttagtaatttagtaattaagcttcccactttcaaatttactaatgagaaaaacacgcacacacacacatatatacatattactctgttattatactttactgatttgaatacatactcaagtaagtatataaagctggctactgattgcatgtttttgcattgacaatgtataggtcaagtcttgtttagacgatcttctgtaagacaccttgagtttatcagtaacctttagcacagttgaatgtttattttgctaatttagcttcaggtgctatggttatcattacaaactaactctaatattctctgttactcaaagtataccctagagctcaccaggatccatgtcacctggaactcatcagaaatgcagaatgcctacctccagagttacaaaatcaaaatctgcatgttaacaaggtacttaagtggtttgtgtgcatgctaacattctagaaatgctgttagacatagtgcttcccatattgctttaaaatagatatttttctttaagagaatgaataaatgagtaaactaactctaatttagcaatgtgaactgctataattcaatgtcattggacttagagttatagaacttctagttgatagtttctcctattttgttttttgcttaatgttgtcataggtctactcttatacaaggcaaggggccagggaactggatgtaaaggtttacgctgttcaagacccactagcaaaaactacatgtataactgaaaatcaatgtgaagaatattaaaatatttactactttataaaggattaggtaataaccaatatgttatttttgcttcactttatagttggtgattaaaattccaaaatgtattccatcacacataaagtatcataaagagcaaaacaggaaaatatttttcaactatgtggtaaaatatctaatataagtaaataataaatggaggatataaatgtcaaggacaaatccaaataaaagaaaccaggatcctggctgcagctctgagattaacactgtgatttgtcaataattcactttacttctctgggttctagtttcttcactagaaaacaagagattgattcttattttacatcccagctctaaattctgaaatctagtatgtctgaaatcaatgcctgttttgtcatctcagatggatctattgaaattcaacatgaaatctcagaaacagcataaataagtcatccttggatttctgctattttacttgcgaagaacaagagcatatggatggctacctggtagtgctcacgtaaaggcattctccccaagagttttactctaggcaaggggacaaatggggatggcagaacgcattttaattcaggggaacctacctgggttatctttcactctgaatcaccaaatcaaattatgtaaattcatcccccttgatgactacctacttccttcatatggtctctatgcgtcctgagtgaatacgggagagcttatacctttcataactttacaaaacagaggattgctgagaggtagttataattgaaaagttacatagttaatctagcaccagaaaataaactgacaggtcttccagggagctaattattgaggctgctatttggttcactgacaggattgcttgtttgtgggaagaaacatatttgtgcgttgctttttccattaccgctatttctatcatcataaataagaatcaataggccattttgcatagcatatgctcaccactattttgtatctgagtgtcagctgtatgcaggctaagcagcagtgccccagtctcctggctgagaattaaaacccagcaaagaaaacacctcaaattccacaagacagtgtatatgtctttgtgagctccttgagagcaagggaggtctgttgtttgtctctctatctgaagcacagtgcctggcacatggtgagcttcaaaatgtataaacaactaaatgaataatgaatgaatggatggatgaatgaaacaaaggaaggttttaagataggatatggaatcaactgtatttactggatcagtcaagggatgtcgttttgataagcacagagctatttataattcgtgatggagacaggaaggaaaagacccggcctgagtccagagggagctggcttttgtttagcagcttaacccacatactcaggtctctacaatattcactattgggtcctcactatagaagacaagaaatcagaatgacagtcatttaaaaagtaaagcaaaacttctgaagaaagactctactgccaatgagaacattgctggacaaaacaaggtcaagtaagggactgatcagaggaaagataggaatgagaaaaaatgaggcaatgaagggagaggaattgtggcagaggactgagtggggaaataagtgtgtgaaaaatgtgtaaagacagggagaggatgaagatgcaattctcaagagagtctgtgggtgtctgggttttggagagtggaaagacactaagcctgagagtacaatgagggagggaggaaggaagggagggagaggtcagataaaagtctataaaataacacccatcaccactgataacaagtataaaagagtccttttttcttctcgagaaagacaaagggaattttaagtaggattaagtagtagtagctttcagaactcagcagctctcagaagcaataataactacataaatagctaagtggatggtaggaattacctcacttggaatttggccagcaaatcaaaagttagcagtaatatcacatctttttgaaagctttcctgagattctagaggggaaaattatctcagaaaactgtttctactgagtaaatttcaggaagaaatgctcctcactgcttgaagatgttctatctctggaaaactggtaagacagaagtccctccctgctgggaagcactctctcatccaagtaaatacattgccaattttgcccccaatggaagcaaataattacgttcgcagatcaccgtcgcctaatgtaaaatgttactcaacacatataacttaacctaccaatgatgttctgaatgaacaaaaagggcctcatggatatctcactttcagagagtgccttaactttttgacttattgcaggtagttaaaatgcaaactttttaaggccacattttaaagcactttgcaaacgctggacacctctactcgtgaatatcctgtaaatttttcctttcaagtacatttgaccactaacatgccagatcatcttcccttctcccctaaaacagaaatgaaaactgggtaaaatggtaatttgggagacaaatatcttctcttatcatctgaaaactgtcatatgttgcttttttaaaaaattaaattagtgttatttgttttccacccagagacaagttattttggtatcacccacaatggaatttgcatgaaaatctgtttactgacccagttccctaggggtgcatttgccctagcacttggagtaaacaccattttcattgcactagaaatagttctaattggacaaattgttataattttagcaacacccaaataaatcaaaggaattggaggcagacatgccacagaatctggattcggccacaaaccagttcagtatttgtgcctgaaataaaagtctagtcatataccacctacagatgctaaaggaacagctacatacctcaactgaacttagaaaatatgatttttttattgtactttaagctctgggatgcatgtgcagaacgtgcaggtttgttacataggtatacatgtaccatgatggtttgctgcacccatcaacccatcatctaggttttaagccccgcatgcattaggtatttggcctaattctcactctcctttcaccctcaaccccctgacaggtcccactgtgtgatgttcccctctctgtgtccatatgttctcattgttcaactcccacttacgagtgtaaaaaaaaaaaaagaaagaaaatatgagtttggagaaactggttattctgaaaacagcctattaaaaagttatgtgactggttaacagtgtgtgtgtgtgtgtgtgtgtgtgtgtgtatgagtccatccatttcattaactggggtattttcactaatacagtctaaataacaggaaatgaatttaaagagaatcaaacaataacattcagaactcaaagttaagcatagtgtaaaatatatctcagtggaaagcatgtaagtgcttaacttaactctccttccaaacccatctataaactgccactttgtattttccattcatgtatcctcctctccaagaagctggacctttttactgctgttcacgcacctacacgtcacaccctactccatgcctttgtcctgctgactccccatttcttctcatcttggatgtctttcccaaatccttgtcatcaaacactcatctcctccacagagctttggattttacaatgtaaacttacatacattttctgaacttccctaattatctatatccaaatttagcatttaattatagaactttcctctctgattacgtatatgtttgtgtgtaccttcttttcccccaaccaaatcacatgatttaaaggtaacattggtctttaatgcctctccttaaagtttccatcaagatcctactctgcatttattctctttcactagttatcccttctttttttttttctgaaaacatgcttaaatgtgccctatcctaaagaaatctccaattctttctcaagctctcccaccatacctactttctttctctcaaaacttcttgaaacagcatcctttcctccacttctattctgttctctctcaacccctctaatttggttacccaggcacacccttatctctcagctgcaagtccctgcagcactgaaacctcacgcacctgtctttctcctggagactgagacaaccttgactcccagttcatctccttcccccaagcccagcattctcagtgtcctttcctggttcctgcccttgaattctcagtcatcactcctcatcttttctcagtctcccatggcaattgcatctctgcttttgtctttaacttcaaaatctccaagacttcctaatctcaaattttagtgaactgtctgtggggtcccagaccttatgctgccacctgctggccagtttcatggggctatctcagaacaaaattcaagtttattcccaaacacctaaccattctatttattttatatttcctctgttaactaattacatcaccattttcctagacctccctgatagaggtttaacatcagcatcctccatgatttaacgatctttgccccagcatcaaccactcagctggttgttatataaacacaacactatgtagcgttagataaatataacactacgtaccaaagcgtctgtcctgtgtgttacatccctagctagcttttttgtttgtttgttttgttttgttttgtttttttggagatagagtctcactctgtcgcccaggctgggtgcagtggtgcaatctcagctcactgcaacctccacctcccgggttcaagcaattctcctgcctcagcctcccaagtagctgggactacaggcgcccgccacacgccgggctaattttttgtatttttagtagagatgggttttcaccatgttgcccaggctggtctcaaactcctgagctcaggcaatatgcccacctcggcctcccaaagtgctaggattacaggtttgcaccaccgtgcccggcccctagttagctcttcttagaccatgatggcctgtccccaggatactggatgagtcctcattgacctgcctccattttctcccctgaaccccaatcctcttcacacttctgccaggcaaatcttcttgaaccgagtgtctgagcaattctctagatgaagagcctcaagacattgtgtcctaccggtagaataaagcccaaattcctcaactctggaacttctggaaagaacttcaagactgtgcatggtctggctccagactatcatcaaagcctcagctgtcatcacgcttcctctcgcgatattcactcttgctccaacctccctgaactattttttttttcctttactttgaacaaaagagccttactctggcgctagagcttgtcatgcattcctgtcatatctttacatgactgaccacttcttgtcactcaggtcttatctcaaatgtcacctcctctggcgaggcatactcagaccacacagtctaattaccttcctcctcctaatacccaggttagtctttcacagttaatctgttgtatttcttctaagcacatctcagcatctgaacacatctgttcatttatgtttattatggagtgtccatctccccacactcaaatgtaagcccgtgagcatgaatattgcctttcttcactcaacccagctcctggaaaagtgcctggcacatggaagcctgaaatcagattcttccacagtgtggcacccatttccacctccttgttctgtctctgtttatatgtctgtgctagcttttagtatattacatcttttatttgaacagctatttccaaagaaagtgaggaggagggaaaggaggacatatcaaagtctgggggtggcagggtagaagaaggaatgaatcatttctaaaacacacattcaagttgtgtagttttcagtgtaaaggatttgtgcatttttgttaaaattgacccttatatatgttgtatgtttttgatcctactataagcagtattctttaaatttcattttctatgtgttagtttctaatacgtatattaaaaatgaatgtttatattgacctcatatctgtaaccttgctaaatttactgctcagttctaagtaactctgtctcaaaaaaaaaattatgcgagttttttttctatgtgcacaatcatctgaaaataaatatagttttaatcatatattcaaaaatgcatattcaatatcattattatttttaagcacaagctatggaaagtaaagcatctaaaaatcatacatgttccaggatagctgctatgcaggatttaagaaaataatagtattatagaggacagcgattaaaatagttgaaaaatactgtcttatagcaacttatcatgatacatattacattttgaacccctggagagcaataccatgtcttatttgtctgtattccatcaaacctaataaagtacattttccaaagtagacaataaatgtttcccagataccccagtactgtatgcatggtatatgttcaataaaaacttgctgatccattgaaagaaccaataaacaaatttaagtttgttgaatgatcagggtatgctcagccctgagacactataacaaaaagacacaaaaaatagaaaatacattcatcattatccatatagaaaaacgtaatttatcaagtaatgaaaacaaatgaaaatgaaataaatgcaccacaggaaacatttgagtggttacctgtgcatttctttatatgactgttccttttcccatgtgatcctaacttgcagccaaaattctcctcccagaattctgcaaaccacacatttcttcgattattggcaagagttcggcttctaaagtatcgatcaaatcctatttcaaaggagaaaggtatgattttaatattctttcaaaattaaatattgtcagaactttcgaatggacattatattctgatcactgcatgaaaagaaaaaaacaaaacacataacaaatgagagaaagccagtagcccataaataaggcctctcttatggcaaaagtcaaggaggatcaatggacaatccccccacaccaccaccagtacccaagcacctggctctatgaataagtacaacaggaaagcctggtgtcagcgaccttcttaaaccctctcctactctactactcccagaggcagcaaccagtgacttcatgctgaatcctgaatacttagaacccaacttaaacttgcctcattcttttctctttcctagcatggatcaatgttccagactttcctgtgtttccacatacttcaaaatttctccttcctatatgttctgttttcaggtaattcaataaagcaatcatgttaatgtcatcttatggagtcatgaactcaagtgtcggtttgctcaggtaactactttattgaagggagaccccctggaaataatgccttactccagaggataatgttaagatgggaatttcagtcactgtcaaaccgactggaaaagatgtttagaagatagactgcctttcaggatgctccaagtctttcctgttgcatttatttatccataggataagcccagcatcatatatattcattttctataaatcaagcatttccctccaacaatgctataaccaccataaatacccatggaaatacgcaaactcaaactcaaagtgcaattactaacataatggaaataactgactatggtctttttcttaaaaaaatataatgggtcctctttcctaaatacatacacacacacacacacacacacacacacacacacactatatacatatatacatatatatatgtatatgtgtatatatataggtatatgtgtatatatatatgtatatgtgtatatatatatgtatatgtgtatatatatatgtatatgtgtatatatatatgtatatgtgtatatatatatgtatatgtgtatatatatatgtgtgtgtgtatatatatatatatatatatatatatgcatatgcatgctggtttaaatactggtcttgacaattctgccaccaaagctaaaatttgtatcaagtcatcagtaatgagtgcatttcctcatattatgatactccagttttgcctttgagttcagatccaactggaataaaacaaattctctatggtgcattcttaccatcaattgatgctcgtttgggcaaaattgtcacagccccttctgcaatctcctcttgctgatagacaggtgctattttggatccccaactatctgagccaatccagagaaaatgcccactttggtttagtttttttgctgcttccaatatcctcctacaggaataaaaataaataatgcatatcacatgtattaaaaataccacaattatgaatattacaagaccagatttaggaagttgtatacactcagtaggtcactgtttaacaattaagacgatcattctaactgcccgagtcttatcatctcctaaaaacaatatagcagagactaactccaacatatgttaattagccttatccttaacctcattcacatcattctgtctatcacctttgtttgtcttatctcatttggtccccaagttttactctgtaggtatttcagatttacaaactagaaggcagtctgttattggaaggcaattacaagcttttatgttgaacatgaaatatgttagaaagaggatatgggacacaaatctgaccctacatacagaagaaaagtaatcagcacctgatgtcatcctcattggcaaacataatcactgctcgagcattaggtgtttctagcaggcgtttgataattttttcaaattctccaggtcttggttcacgtgggattttctgtgactgagcaatgcaaacaccacctatttaaaaaagaagggaggtggtgattcagaaagagcatttatttaattagcaaacccaattacctactttataaaagcacatacttctgtatgaatattatttctcaaaatatgtgtcactctcacctattaagagcaattgtttgtttgcattataatatattcaccaaataaatgacaacaattattaatcagacatgggtttctttcccaatatttaaacattatttttgtggatatagctaagaaaaccaaggtgtataagatgtgtgatgagagtcaaaagatggaaagaagaagggatcttttgatttatgcaacataagccaaaggacaagtgacagaattaataaaagtatgaatatgtcttatagttgagacccttattaagtagcaaagtccttttgttacttttatttactggtagacttcttttaaagttaatttcattgtatagctaatagaactgcagcaagatcctcatgcatcagcatagcaatgtcttatgagacaagtggtcttcaaggctatgtaagacacaggcaaaccccaaagatgccaactttggattgacatacatcgccactatgaaaatcgaaatggcagaaataccatctcattttcactgcaaataaaaagacagaacccttcttttggcctctccttcttaggcaatgaaggacaaaagagaaaagtatagaaaagatctctgcctctgggctggggtaggaggagaagaaagaggttcccccagttgcagtgaaacagagataacattctgaaactagatgagaaagcaatattagtaataggtttcaactgcattatggtataaacagtatttttttttagtcagctaagaattaaatcaccatttatagcattgcttcagtaggcaaaggcatttttacttccaaacaattgccaatgcactcagtcatccaactgttattggatgccattatattctacgcactgggctcaacattggaaatgcacagtctaatccaggagttaccacctagtctgggaaataggcatttgaataagttaccatggaatagataataaagtatataattaataggatacccaatacaatcagaacacagaagaaggagtaactaaagtgcttgagagaactgaattttaaagagcaaatatatatccacatggggacaaaagtggaacatgtctggtggaggccaaagtatgtaaaaacctagcatgatcatggcctatggtagagactggctgggtttgaagttggaaacaatgaccaggtccaacttgagaacggctttgttagacatgccaaattctgtaggctgagtgttcatatgttaaaacttaatccccagtgtgaaagtattaggagatgggactgttgggaggtgattaggtcatgagagtggagtccttatgaatgggattagtgcccttataaaaaagactccacagagatttcttgcaccatctgccatgtgaggacacagcaaaaagacactgaaccaggaagagggccctcatcagctcttgaccatgctggcaccttgctctcagaccttcagcctccagaactgtaaaaataaattactattgattaagccacccagtatatgataatttttattttttattttttagatatgggggtgtcactctgtcacccaggctagagtgcagtggccagatcatagttcactgtagcctcaaagccctaggctccagtgatttgctcacctcatcctccggagtaactgggattactctgcacatgccaccacaccgcactggtctcctataataatttattatgcatttcaaagagactaagacatcaaataacttggactttattttgaaaacaatggggatccattaggttcatcagcaggagaaatatatgctgagctttatgctttaggtagactttcaaagaagaaacgtctggtagccaaatgacagatttccagggtgctgtgatcggacctaatatgtacagcagatgtatgagtaactggtgccagtatataaaactatttttcttttaagttagagaacattcaaaattatgcctgtaatagcaggactcttagtaaccttacaatttgcatcccaggggtgggaattgcccataatacacagattgggctgtgtcactacctgcagttagctagtctaccgatatactaccactagttgtgataattgattcattccttcagtaaatatttcttgagtgccccgtatctgctagatactgtgtgggtgctgtggacacaatggtgaataaaagaaattctctaagttcacagaattcagaaatattgtgggtaactcaggcttaatgcaaactaaaaagaaagaagaagaagagaaaaagaatggagacgagaaagaagaagagcaggagaaggaggaggagaaagaggaagaggaagaaggaggaagaggaagaaggaggaagaggagaaagacaaggaggaggaaatggaaggaggaggagcagatggaaggaggaggaagagatggaggaggaggaggaagagatggaggaggaggagtaagagaaaggaggaggaggaggaagaagaaaggggaggaggaagagggaggaggaggaagaggaaggagggggaagaaggggaaggaggagaaggagaaagcagaagcagaagaggcagaagaagaaataatacataattataaattataataagccctgtgaggaagagcaaaggaatttaatttagattgaggactgctcagggaaagccaccctaaagttgtgtaatgtagttgagatcaaaaggatgagagcatgggaaagggcaggaaagggccaggggagtcagtgaatgagggtgagaggagtgggcaacaaaaatgagatggagataagggtccaattgtgtgtggctctgcagggcctgtggaagactatgaataattaaatgcttaactttctcactaaatgtttctatttcttcgatctttgagtggcccataggaatatgtctcatgtatgagcattgcactccacggaagaaaaatggatgacgatcgctgatacagagggcagcctgaagtgggatgaacaggaggcaatgagccaagcaaggaggtattggaataggcagtgggaaatgatgactgagccagcgctactggtgctggggaggagcagctggagctaaggcagaatctctgagttagaatcaatggggctttgtattgatttgatgtaagtagggaagcaatgggaaaccgctaagtatgactccaaggatttggtctttgtgaccagttatgtgatggtatcattaaacaagtgggaaatccaggaggataaggaggaggaaagaatgattttgattggaagcaggttgtcttcaaagtatgcatggaatgtcaaactgaaaaagtgaatctggagctaaagagagagaagggaattgtaatactttcgtcaggggctgataggttaggtatttgaagtgttgtggggcaaagaggtcactgagagagaatatttaaatcagcaatagaaaaggtgaattatagaactctgaaaaaaatcaggtttggagaaggaggaaaggagtgattaaatattttgagaaaacttttggaatgaagtctagaggtaagttgaagactatgtataatttatttaaaatgcaaacaaaccaacctccgtgagtggaaacattaggtaactgcaaaaatgtaacatgaagtaacactctatagggaacaatagctgtttcaaaagatgactgcccttttaattaaattgccatgattacttaagcatcccattaaagacatgttatatgctgagtatcattctgagactgactctgtagccataaaaaattaagttctgaaaatttttattattactgtttcagaagaagcaaacaagcaatccaaacatagtttagtctgaattcattgatttatttattcaccatggacctattaaacatttttgtttgtaaagagctgagttagctgagttgaattttaacatagcttaaatccatttcactttttgctattcccacacctcacctcatatctttcaacctggtcagtttgaattttcctggaaagaggcactggactattaatctatttaagctgaacaaatgcttgtagagaacctgttccacatggcattgtgctgtttggtgcctgtgtatattttattaaagtgtagataaattatttctcaaatgattgtagttagaagactgggattatttccttaaccctgatacccattcacactttctttcttcatatcagtcaaaaaccagacagctaatctgttcataagcactcatggtctactatgtttcaggagctacagacaaagaccgccagtcctcagcagttatgatataattgaatgacaatatgtacacataagaaatgtcagacaagggtgtaaattaggtaacacagataacagcataagatacaccacagttcagtcataaatgacaaataggtcatcccctaaaatagtcctatgacttcataagaggaagaggttattatatactgttagaatttggtttaaaaaataaaatgaaattcaaagattcagacctcaaagatacgttttccatacaatactccacatccattgcttgactttttaaagagactctgtcttgatttaaattcctggggtgggtgggaggaagagaagttgcccttcatcaaagaatgtgtccaccacatctattcttccatgtctcagtctgaaagattactaattgtgtacaatttaagggactttaactttcctattctgcaggggtgttactgttctgtaatttttaaagcttagtacttacaggcaaaatgttatatgaaggaatttataattggctgttttctagaatttcctggctagtttccttgcagcctgtgtattttttttccttctggttacttaacaataatttaaagatcatttgttgaatttaacactttatgtatactttacaatacacatgatcactcctttccagtctcatttactcaatgacaccatctctattcctaatggcagaacttgaaggtttgcatcatgaccatctttctgataaggaaaatgagaaacaggggtaccaacggcttgcaagatactgaaatccaggttcaaagccagatttgtctgcctctaagtctggacttcttccatcatcttacccatccacaattgactatacctgtggcttaatggtttagtgactgcaaatgattgatggataagataaagcaaatttaaagactctttttttttttaaaaccctgccagttgtcccttgtaaatctaattgacagctacataaatacagtccttctgttatcctaaataagagtttaattaaaatacttggaatctatgcagattatagaagtgacttaaagttcttcagcatatagccagtctaccctccaaactttccaattgtttctgttgatgcatgttctcaggaagacttttctgaggttcttgtcttccacttctttcatactgcagcaatcataataattttaattttacttttttttgttacttctttttctttttcttcttcaattagaaatccatgagtattgaaccttgtctttcaaatttatcagtataccccaacatgtatcactgcgtttggtacatagacttcaacaaacatttgttgaatgaataaatgcaagacttgtgacaggtactgctaggatagagaaatacaaatgagacagtgctgctttcaaagacttctccatcaagtaggggaacaaatagctacatgtaaatatatgtttaaaagtagatgtcattaaaagaagtaaaaaaaatatttgggccatgacaattcagaggaagttgtcactgaaatgggatctgcctcccaaaatagtttttattagggtgccatgaattagaatactacctaggccttagtgtattcatctgtagagtggcattagaatttcctcatattgatacaagagcaaatttgtaaacaatgccatttcagaatttttacccctttagaaggctgagacttgtgggtgagtggtcaggtgtcacagatatgagagataaaaggcttgtatgtattgatttgctagtgcatagagatggtggaatgagaaagaaaatagacttgtcagaagacctgagagtggccccacataatcttgaaaagtctctcatctctcagtttcctcatctctgtaatgaggttcataataactatctctcaggtatactgtgagaatccaattataaagggtaaattcctatgccaatgtagcatattattattagtgttaataacagtaataatcatagccagacaagaatcatcaccaacactgagagatacttgacattcagccctaaaacacaggtttttcaacagatcatatttttgaatcttcaccattttatgtgtaatattatcaaacatcctaaattctgaaaagtgatacttgctcacttgcctgtgccaatagatgaaatgactagatttcactcttcatcattgttgattacaatgtgatcggggcaattttaaggtgagagaatgagaaaagttatttacattcttctcccatcccccagttcctacccccaagaattaattctcctttcaaatggattccataagtagtaaagatttggctccaatatctgagttgaaattagaatttaactctttaataaaatggttaaaactattaaaatattaacgggtgccaattgttaagcaaaagttgttatggaaacaaccacatgttctgtttcattcaaacatttgtgctacctttttaagaggctggaatctaatgtgttgagataataatgttggactctcctagaagcaaacctcagaaggagtttgaaatgcacaaaatttgctcttggcatctacctgatgcagggctcaggggaagcagagaaatccaggcagagaaatccagctggctgtggcccagtgacaggctgctgacaccacaagaagttctgaggctagaatggccttcagagttgctttaaaacaggccacaaaggccaggccattatacctccacatcaatcagtgcgatgattcattttatgtatcagtttgactgggccacatgctgcccacatagctggttaaacattatttctaggtgtgtcagaaaagattggctgggcggggtggctcatgcctataatcccagcactttgagaggccaaggcaggcagatcaagagatcaggagatcaagaccatcctggctaacacagcgaaaccccgtctctactaaaaatacaaaaaaaaattagctgggcatagtggcaggcacctgtagtcccagctacttgggaggctgaggcaggagaacggcgtgaacccgggaggcggagcttgcagtgagccgagatcccgccactgcactccagcctgggcaacagagcgagactctgtctcaaaaacaaacaaacaaacaaacaaacaaacaaacaaatagagaaaagattagcacttgaattagtggactgaataaagcagattaccttctccaatgcaggctgggatcattgagggcctaaatggaacaaaaatgtagaccaaggttgaatgaactcagcctgactgcttgagctgggacattgatcttctcctgctctcagtgcctctggctctgaggcattcaaactacaccactggttttcttgggtctccaatttgcagacagaagattgtaaaacttttcatcctccataattatgtaagccagtatctgacaaaaaatctctttggttctgtttctctggagaaccctgaccaatacaatgaatcatcagacttgggccactctggaagaggggaaggtgaacttggccaaggcagctctctgtagccagggcattccctcacagggttcagagctgaaggctgtctgcctatagcactcccagaaataggaataacaggtcatgcactgataggatcttgaaggtcaattcaccatatgtacattagtgttaataatgtataattgaaatttatacaaaaatgaagatatcatttttctgaaacaaccgtagactattgtttgccttataaggcaaataattaatagaatgttattatttaatgttaaaacttcctttcaaagacgtcttgttgcacaaacaaaggcaatctatacaaatgatagaaaactggaattgtagcctgcacaagtaggagaaataggaccttcattctttctggtttttcaataaagaagttttgttaaaacaatctaaaaggataaagaattatgtttttagttgttgctcatttataagacaaaaatctctattaataatttagtaggagaaaaataaaacaagaaacaatgtcacagcaccaagttccaactgtgatggaaattgaggattaacttattgggatgaaattacttacaaagctgtgtatagaatactaagtgtgcatttttaaaaaacaacatgactacagtattatcagtatctcaagttggttcacaatttccatcaaattaaattctacataaatcaactcaagtctgtggttatataatttgttagagctacacgacagaccttggttttggtgtacaaataagcaaacaaaattaccattttatcagttgttaaagagaatgactagactattggttaaaaatgattagacttacagtttgaccataagaaatttgcctagaattaaacatcttttgatctaataaaaatgtgatacagcccatccaccattatttatttcttatgaacatgccttcagataatagcaatgagcaaaacaaaataaccaggtgtttttttaaggcaatagaaacacataaactctctaccctaaatatccttagcatcatttatatttccatctttctgaagacataagtgaactaacaatttgacctaaagtaattggtcctttagtggtagttgagtaaaatttgttctatggtttaaataagtgtaatcacgcctcctgtaacaatattttcgcctcctcatgtggcgtacaactgggacttagcaggaaagtgcacaacatgaaactgtaagtttatcagcttaaagtgtactttgcaaaagagaagatttatctcacacatcactgtaaagaaaaagtgttatctctaccaacatggattaaaagagcaaaactgcacttatatttatgttcattttctctttctcactttcaaacattttatactttttcctctatcaaatgccatgtggaatcttaaagggactctgaaaagcaatgcaatgaaggaatggtacagaagaggcatgtgctaccatgcatagggaaataaagacaatccactgtgaaacgggactgcaacagaagcagacacttctcaaaagaagacatacaggtggctaacaaatatacgaaaaaaatgctcaacatcactggtcacagagaaatgcaagtcaaaaccactatgagacatcatcacacaccagtcagaatgactattattaaaagtcaaaaaataacatgttgatgaggctacagagaaaaaggaagacttacacactgttggtgggaatgtaaattagttcagccactgtggaaagcagtatgaagatttctcaaagaaccaaaaacagaactaccattcaacccagcaaccccattacttgatatctacccaaaggaaaagaaattcttctaccaaaaacacacatgcacctatatgttccccacagcactattacaatagcaaagacgtggaatcaacctaggtgcccatcagcagtggactggataaagaaaatgtggtagctatacactgtgtaatgctatacagccataaaaaagaatgaaatcttgccctttgcagcaacatggatgcagctagaggccataatcctaagcaaattaatgcagaaacagaaaacaaaatatttcacgttcttacttataagtgtgagctaaatcttggctacacacagacataaagatgggaacaatagacactggaaactccccaaggatggagggagtggggcaagggctaaaaacttcctattgggtactatgttcatcatctggctgatgggatcaacagaaacctgatcctcagcatcacacaagtatacccctgtaacaaacctgctcatgtacccccccaatctaaaataaaaatagatgcttttttaaaaaagaaaatcataattaaaaagaaaaggaccttggcacagagagcccctctcctgcctgtctgcagatgtactctcagagagatgctgtgatctggaggtggatcgggtctaggtaggttcacagggtcagcgtccacgctgggctctcactcagccacaactcaccaccgatctggaggtctgctcagaggaacagaggagtggggtgaatatgaatctcgtctctagggtcagacttcctaggtccaaatcctggcccttctcttcttagctatgtgagactgggtaagtgaggtggcttctttgtacctctgtccctcatctgaagattgagaagatggcacccaaatgggctttgtgaagagattcaatcgacactcaacacattacgttttcctcagaaaacacctgctagttgtaaattgtttaaaatcaaaatcaacagcccccacacagaaacagtgattgtctttcatcaagtgatattcacctgcattatttctagaaacctcaaatttcattctccaagtatacacagaatcacaactcatactagagattcctcaagggggatatagagtcggctgcagaaagctgtatagttagaagaaaaacttatgctcaccacaatagaaatgaatgtctgatatgttgcctcttcttacctcttcctttgaattagaaatgtctaaggagacatgggtacaggaactgggaaagagtcagagaaacaaagaaagaaatataaaagaagagaaccaggaaggggaaaggggagaagagaaatggtggcgggggagaatgaaagagaacaagagtagaaagaggagagctgagagagaaaacccagtccagaggtatctatggaactgggcagaaaaggaattctctgtagggtcaaaaaagcaagtgcaggatgaggaacaattggagaaggagcacttgactaggtttaaatgaatgtcattaatgtgttgtgtgcatttgtattttctttggattatgttttggtgagtgatttgtgatctttatttgttctatttgtttttgccatttcaaattaggttcccagactctgcagcaaaaaatacaacaggaagatttcaaaagagaaagctaactccttctaaatgctcaaatgaccaatatgaacagactctctgacatattttccagcccattgcctggaaaaaccattatgacaaagacaatattgaaatcaaagtgagcactgtttaaatttcttacctgttctggactttaaaacagcattagactttgaattaagcccattacagaattaataatttcattatggaattgcagcagttaaacaccccagtgtatttctaagtctagtgaagcctgatagctgtgaacactcattggatgtgtgacaaatacgtgaataaataagaagccactgtttcctgatatagtgaaattatctaataaatagataagcatatccatgttttaaaaccaccatcattcagaaaaaggcaaagtatcttggtatctgtgttatatgtgtacatatcataaagtcatttccaaataccttctgcagataggacattctcaacagtatatcaacagcagctatgagagcttataatctatgtgcactcttctactcagcaccaagtaatatctgattctacttatcagcattacccgaattctgcaatgtattagctttcaaacagtgaggggtctttgctcaaagcagcattttcaacagatacagtggctgagattctcaatttaagaaagaagaaactgatagcagaaaggtcattattattttagccaaataacccttctgagcaagggttgtacaatgaccatggtacggcagtaaccaaactaggaaatgaacttcagagaacaaacatcagcacccaaagcatttaaaaactcagtctttcaaggaaatgcaagtaacatgtagtgtttccctaggtaatgcaagatcattccctataggaggatttgatccatgtgtttagtacataaaaaggttaaaaatgcagttacgtttttaactttttggattcagatagcactaaaaagaaaggatagtgaatagatatgttttggatagcaagccatctaacattttcttgggctccagggatgatcctatcctggcctcccaagtagctaggactacaggtgtgtgccaccatgcctggctaatatttttgttttttgtggagataggggtcttgctatgttggccagctggtctcgaactcctggcctcaggcaatactactgcctctgcctcccaaagtgctgggattacaggtggaagccaccatgcccagcataattctttgaaggactcttgtcaaaatacattttggactagattttattcaaaatagaagacaattagtaccttgagatgcaaggacctcctccaaccacacacacacacacacacacacacatggacacgcacacacacacacgattctattaccttttccttaatgaaagatctacttttagaacaaatcgcaaataataatatatttgaacagaaaaatactatttcactaatgttttaatatctaatttcagcttcataatatcctaatgctatcaggttagtagggtaaacattataaatttatttttacatggaaaaaactgtccccaagatcacacagctattgaggagtcaaatgcaaaccttgtcaacctaatcctaatagcaaataattactgtactttgctattatctctcaataattgtctccttggtcattaggttgcctcaatgtacataattaaatacaacatcaacaggtaaggtggtatattcaaaatgcgaacttcaaagttttacatcatcaaggctgcacagtttagataaatgttttttggtctggttcaagttggacagaaatttcattgaccgacatcctctcaaaagagcctattgcaagctattttctccataaacccgggtctgcctgtcatcactcatggagcattaactgagctcttgctacatgctgagctctctgttagaatctgaagttacatgaatgaataaaaagacacagtccctcatcttcaggagataacagtaaacaacacaatatgtaaacaaatattacaatttgatgtgagaaatgctatcatatagggcagcctagggacaaaagaccaagaaaatggaatttggcaactgtaagtaagatttactggttcttgccagcggccttggaattacgtagccagagaagcataaaaaatagttgtatgatacattgatatgcatcagaatcaacaagtcagaaaacatttcataagtgagattatgcttgattcagccagccaaaaaccagaaaaatctatttctaatggatactaccagtccacagagatgcatatttcctttgacaatgttgtcattaaatatgatgtaataaacaccctgctttatgtacaaaaggagatttaatctaacttttccacaataagaagcagacaactcatgttactgtagaaggaatacagaaaaaaaattaagttagccattaaaatgaccactggaagaggaaatagcaacacatcaatcctaagaatgaaggatttcagctggactcaataaaatgtaatcacaacagctatctacaaggctttactttaatgataaaacacatcagaacttgtgagaataggtttttaaaaatttattcctattattggaaattctgaaaatgtgcaagccaggtcaatattgcattatttaaagatgcactgtcaaacaatcttttactgaaaccaaaaacatctacattctcagtgttataggaaatatagccggtgttttataacattctgcattaaatggtattgtttatctaagggggttcttagaaaagaacgttaagctttcaacaatcccaacatcacccaagcacaaaaatgaaaaccgatcagaactgcaaatgacaaaaggataacaatttgttacttcataaatttctgtgatataatttccacaatttccattcatgcagtgacttctagataaaactcattctccttgcaaatgcgttatagcttaaccatatataacatgtaaatatctacaagtgaaaagcagcttagcttgtttaaaaaaaaaaagatcctggaatataaacagagtaacagaagcactcgttcaagttcactcatggcatgctatcctcttctcatccctgcagtggagcacacccatgttccctctgcatgaccctgggcaagatgtgtaacatttgtggctatcagttccttcatttgtaaaaagaagggtgcttgacaggatgatgtcaagatgcctttgaatttcaacattttgtgtttctatgaatataccacatagctgcctcccatgagtactgtgaattatgtaagttctaatacgggaatagaacatcatgttaaatacaataaattgctttttgaaaagcctacaggagatgaactagagggtacatcagaaaacttttccaattcaaaattataaatcctgacttcacaagtcaaagaatgactggggatcttaaaaactgattttttgttagagtattggagccttggtcaggtgctagggatctgatgaccagttcattgaagcattatagttctcttgtcagttcaaaaaaaaaaaatgaaaggagtgttggggatgggctgaagatgaagacaacaatggcttccattttactattcaataatagcctcgcttttcctctcctcgtccatttctctctcctatttcttgatcctgctcaactttccctttctctcccttccctttcccttgtcttactctgtctttcccattttaaaaacctgaaaatggagatgagccacctgatacaacaccctttcaattacttccatcctgttactctgagactcactaatagcagcagcaaaaaaaggactgttgcatggcctggcctcttgctgagcatggaaaatagaacacattcatttacctccatgttataaactgaatgtctgtgtactcttaaaatccacatgttgaagccctgcccctctgatgtgatagtattacctttaggaggtaatgaggtttagatgaagtcatgagagtaagactcccacatgggattagtgtccttaatagaagaggaaagatcagactgatctctctctgtctctctctgtctccattcaccgtgtgagaacacagtgagaaggccattgtctgcaagccaggaagacagccctcatgaaaaacccaaccaggctaacatcctaatctcagactttccagcctccagaactgtgataaataaatgtctcttgtttaagctactcagtttatggtattttgatttagcaacctgagctaaaacactctaattcctccaaatacccaactaagttgtctactataaaaaaaaagaggggaaaagaggagagaaatgtcaccaatgttttgaaagctgaaaagcagatgattaccaagttgcaattgacttaccagaatagaaaaagctcagtgagagcccacaaggagtggggctggggatgaggccaacagaaacaaagctggtgttctacttaacatgatgaaggccctggagtggaggtaccagaggctccagaaggtggggttgaaaatggagttggttgaaaatctctaaagtcccttccctcaactccagtccctctgcacagaagatcagagagtcattttctatagaggatgaactcagggacatcaaacacagctgaagacatagtgagtttctatagaataaaagtctgcatgctgaatggatagtccctggtcccctctccctgtttagcatccagactgcagtagcctaacttatctccccccacccacccctgcccccactaaaccccatacagaaaattggaagagtcttctctggagaatctggtccaagggtaatgacatactgatacttacatggatgtttcccaactaaatgaccaattccacctgctcgagctaaagtaaagcccactggccaatgaatttgtcctcacctccaaggctcacaaacaccatgtcagcacctcactcttaatatcacagcagacatttgagaggagcctttaccgtgaaagtcaggaaccaaagcaaacagaagaggtaaacttagaggacaagaaataagacatacatagataacttcaagattattaatatcctcagagacaagaagtgtgtccatgcaacaagaataggaggctaaaagaatagaaacattcagagggcaagaagaagctcctagaaattaaaaaggagatgatagaaatatctcaatagataaggtataagagcaagtagagaaaacatttcagaaagcaaaacaaatgaaaatgaccataaaattggagaattcattcaagaggcttaactttccaattttgaaatccccaaaagagaaaatagaggccattaccaaagaaaaatttaagaatatttctcagaactgaagaataagaacttttggattgaaaatagttataaaataccagcaaaaagaaaagaaaggaaggggaaggaagaaaacctatatgaaggaatattaacacaaaattttaaaacactcgtgagtaaaaaccaattacagagaaggattaaggctcagaatggtttcaggattttcacagcaataatgtgaagtcagaagaaaatggagcaatgccttcaaaattataagaaaaaatgagttttatttgaaatgaaaagaaagcaagttaactatatatcaagtgtgtaggtagaataaagtctatttaaaatatgaagaaaactcaaaaaaatcatttaccttccatgcatacctttttttaggaagcttctcagggatggaatgaagctttccaaaccaagaaaggaaacaagaatgaacaagacccagaatccaagtagcagggaattcaccacaggagaaggaaaggggatttctcaaagtgatgatgaagagaagcagagttaacagccatcaaaggtccaaagatcatcccacccagattagagcagggaaaggaagcctccagaagaatctccaagaagaaaagaaactgaatggatgggctgtttgaggtgtttggatatactgaaaggatatgtacagttctgtcaaagtttgaggatgaattgataagttatatagaaatctaagcatatgacaaagcaagaaatgattaatttcaggaaaaacaaaatgtttaagaatagaaatggtattttagtacactagattaactgcaacatcaaatgcagaatcatgataatacaagcactgaatactaattaaatcagaattatgatacaatcctactggaaagattggaggaaaggaagtgtatgtgtgttcatacgcacatccatgtgcaatgtgtgtactgtggggagttaagtcatcgtcttccgtagtagacaatcaaaatgaaagctaaaaaaaaaatcaagaaatagcaacatgaaaatgttttgtgaaaaatggagacaaataccagaaaaagagctaaaggggttggaaataattgttcttggggatcaagattcaaaagcacggggagggcagtgggtttctgtgaagtccagtagcactatatacaatatcgcttgggtaaaatacatgtttggggccctgatttttaaggtcattaagtggaagtggggatgatatggtttggatgtgtcctcacccaaatctcatattgaaatgtaatccccaatgctggaggtggggcctggtgggaggtgattggatcatgtgggcagagttctcatgaatggtttagcaacatccacccttgctactgtacagtgagttctcacaagatctggttgtttaaaagtatgtagcacctccccctccctcccttggtcctgctcctgccatgtaagacacctgttcccactttgccttctaccatgagtaaaagctccctgaggcctccccagaagcagatgccactatgcttcctgttcagcctgcagaatcatgagccaattaaacctcttgtctttataaattacccagtctcaggtatttctttataccaatgcaagaacaaactaatacagaggaaaaaagagtttaaagatagcaagataattttagtcctgtatgttagggaagcatcttctgtaaccaggtttctctttaaaacatttctccacctttatgcctgtgactgtattatcttatgctgattgcttatttgtttgtttgttttggtggcataataggtgcttgtttaatatttttaggaacaaaatccagaaaacaacctgcattgactaaaataataagaaccacatgaaaatccatgttgcctgggtttaaagcatctgcttttcatgtaagtcaacactaacctactaatctgtccctaattggtctgatacccaaatgtcaaaggttcttttcagatatatcagtaattggttttaataacaaataagacctatcatttaaccaaaaccactactgacactttatctggatattgtttgcaatataatattatctttgttgctataataaagaaaataagagtcctctcacatacagacataattattacccaactaatcctttttaagcacttcaagggccacaagaaaatgaaattcagtggacaaaatggcttcagagaacagggaaacacgtgagaacccagaggtaggtatttgcagtcatgtaccttggcagagtttagtgtcctagctatgaagtatgcgagtttataactttggtaggtgttcagtagtgtttcataagaaaagagagtagagtatgaaatatatcagtggctgtcttccaacccctccagatagagcttgaaactctggcatgagtgcttttaggaagagaagaggtttgagaaagcttcttggcaaagtctgaactaacccattcagattgaaacttgatgagttctatttgagaaataaatcacagattccattaatctgtgattcaaatacatctacatgtattttttaatgtatggtagacactgaggctctggaattaattacctcacagttctccagaaaggatctgagtggtttcttttccaacagcaaatgggccacctacatctagactccttgctgaatgaagagactccttgctcctcgtcatttacacaagagaaaggagaatcaaacatcagcaatagggggaatggtctcacactgaggcccatgcctggcaaggggactgtatcccaactgacagataatttgggatgcaagtgatgaaagaaataaaaggtattggattcatagggcattccttcattttaataccaaataataaatattcattttaaatctcacggatttcaaacatcacttgggcataaacttgggaacaatcatgtaactcaaaagatgttaagttattttcctgcattatgtcattctacaacagggattagactgcataatccctctggatctcatggatgtcccagatacagtaactcgtgcaacatcaggttggcacattgtcttctagtaacaggtttttctcaccctctaccaactcatatccacaatcctcacatgggtggtattgcctgcctttttgcttttctttctttccttcctccttttctttccttcctttttccctccttccttctttcctcccttccttctgattctctctctctttatagaaaaagacactaatcttagaagctgatgacgtcagtaagaatcaggttcttatctggctctaattgtacacagcatcatgcaaaagaatttaatgaacttaggagcctctctgagcttataatgtatataagaagttgaatgaggaaaacgaaggagaaagaggtcactggcccttataagaaccaaatccataggcagataaatgctgcttcacaatactccaggaaaacaagtccccagtgaacgtcctggaaactcagcaggcaagaccacaatttatgtgagaccaggagaaaaacaggcaaagaagagacacacacacagagaaagaaaagatatagaaatggagggaaggaagatggtggttaataacttcaggtagaatgtgacagaagagagcaagacctcaaaacaggaactttttcttcatgttttccatttgttattattaagcatgaaaaactccccaaaatagcacttgattcatcattttcagagctatcacaaggatttcttctatttttctgcagaatagttagcattcaagttatttttgcatgggtgccacagcacaacatgggcataaaactgtgaaaaattaaatagctcaaaagtgtaggtgggcttctgtgaaatttgtgctgaatgaatttttagaaagcagaatgcagtactagaattgctgcacatgtgttctattattaaatatctaactcttctaaattgggaaggataataacaagcaatctgtgggaaagctgaagatctaaacaatacaattctgaaaccaaaataaaactgatttggtattttttacttttttaattgttaaaacatcattgtggagtaatagtacaaagacataaagaaaaatttctaaaaaaaatattgtccatattcctatcatcccagcattaaaaattattatttctttcagtctttatccacaaaaatccataaattattaatgtgcatgtactttttgtgtttggtttcccactgagcattatcatgctatcacaagagaagcaacagaaagaacatttgattttgaacctaagatgtggtttaagtcttggcacacagtcattccttgtatagtcctcataggaatcattttcttagctacctaatatcccacagaattgatgtaaccaattttacttactcttctccttcttcttggacatttaggtcatgaccaatatttcacagttctaaatatcactgcaatacatatttccctgatatagctttcttcttatattctgttttctgtatccttgatataaattcatggcaggttgaatgtatttatagcttttggtacatagtgccaaattgttttccaaaagatttataccaatttatacttttattagaaatatatgattatatagcagacttgccaatattgaatactgtatggttaacgttctcctaatgtaatatatggaaaatgatatcccatcatactatgtaagtgttaaatgttacccgtattatattttaagattattagtgtaagctatcaggagttctgaaagttaataaaattttaaattatagctcatagaaatgtaaaagactatagatattatttaacctagtcttttacccatagagaaatttttgcagcaatatctttgatggagacctgataattatcttacacccctcactgtgcttaattgccctcattcaatgagtcactaagtcctactgtttcaaaccccaaatccctctcaagtctactccagccatcattatctttctcctcactgccatggccttagttcaagccctccttacctctcacctgggttactataataacctctttgccagtatttctgcctccagttcaatagttgacatactgtatgtggtctaaaatttcaatctgatggtgaacgctacttctctgtttaaatacttcaatagcatgttattttcttccaggacaaaatctgaacttcacggcatagcacacaaggctcttcataatttagctcagacttcagtcttatctcacatcagtaactccacaaccatctgccaccaactaatttcatgctcttacaaaccttcatctggacatgtcctgcaagatgcctttcaagggtccactcctccaggagaccttcccaacttcttgtcttcccagcattggttggacattcataacctcattcaaacagattataaacctctaattggagcatttattccattgcactgtgtttgtctagttccacattttcccaaccagcctattggttctttaaggttagaaatgtacttttaactctgtatcttcagtgtcttgcagagtgtgaacccttagtagtggtaaatacatgtttgttggattaaccaataaataaatgaatgctccagtctctgttcaacgtcttccagtggtagtaccttatcaaacagtccatctcattttttatttttattatatttaaaaacaaaaatttttagaagcaaggtctcactccatcacccaggctagaacgcagtggtgctttcacagctcactgtaatctcaaactcctgggctcaactgatcttaccacatcagcttcccaagtagctaggactacagccatatgccatcacacttggtagtatgttttttttttctttagagacaaggtctcactatgtcgactaggttggttttgaactcctggcttaaagtaatcctccctattcagcctccaaaagtggtgggattataggtgtgagccaccatgcccagcctgtttattgtgactttaaaaatcaaagggctcttttaagtttctgctacttgtgactggacaaatggtctgttaaacaaatttaaaagaaaaaaacaaccccatcaaaaagtgggagaagggtatgaacagacacttctcaaaagaagacatttatgcagccaacaagcatatgaaaaaaagctcatcatcaatggtcattagagaaatgcaaatcaaaaccacaatgagataccatctcatgccagttagaatgctgatcattaaaaagtcaagaaacaacagatgctggagaggatgtggagaaataggaacacttttacactgttggtgggactgtaaactagttcaaacattgtggaagtcggtgtggcaattcctcaaggatctagaactagaaataccatttgacccagcaatcccattactgggtatacacccaaaggattataaatcattctactataaagacacatgtacatgtatgtttattgtggcactgttcacattagcaaagatgtgaaaccaacccaaatgtccatcaatgatagactggattaagaaaatgtggcacatatacgtcatggaatattatgcagccttaaaaaacggatgagttcatgtcctttgcagggacatggatgacgctggaaatcatcattctcagcaaactaacacaaggacagaaaaccaaacactgcatgttctcactcataagtgggagttgaacaataagaacacatggacacagggaggagaacatcacacactgcagcatgttggggggtggggggtggggggcaaggggagggatagcattaggagaaatacctaatgtagatgacagattaatgtgtgcagcaaaccaccatggcacatgtatacctatgtaacaaacctgcacatcctgcacatgtgcctgaacttaaagtataaactaataatgtgcaaggtgcccaggcatggtaactcacacctgtaatcctagcattttgggaggccaagatgggtggatggctttagctcaggggttcaagaccagcctgggcaacgtgatgaaaccccatctctacaaaaaacacaaaaattaaccgggtatggtggtttgcacctgtagtaccagacacttggggggctgacgtgggaggatcacttgagcccaggaggtggaggctgcagtgagccaaggtcatgccagtgtactccagcatggacaacacagttagaccctgcctcaaaaaaaaaaaaaaaaaagtgcaaggcactgttaaagcatttgctggcctaaaagatacataaaatagttcatcttgtgtgacttactaaatataatatggataccatctttgacatgtacattaaatatgacgtctacccttataataataggaggaactacaaaactattttaaaaagaaagtgtgaacacttttagggaaaaaaaaatacgtattcaagggtgatgcagaacctcaggtccaatctggctgtatcagagaatcctcttgcaggtcagaaaaggttgtctgaggaagcaaggctggaagcagactgtccacaggcaaaggtgttgatgcatttaatgggctctggcagctgctttcacacatactcagtatggaaggaggaattgaagtagaaaaaaggaggaaaacgaaaggaacaagaaaaaggaaatttgcttaaaggaattaataagtaagcaagaagaccaaggggaagagacattatatcatattaattctataagcataaaaaagcttaaaaataagatagtccaatgccaatgtgatttaattattatgttgccccatttgaaaggaaatactgccttttgtaatctgtctagtgctagccagtggaactttctgctatgacgaccacattctatagctgtgctgttgaagacagcagccactagcgtcataggacaattgagcatatgaaatgcagctagagtgactaaaaaactgagttttaaatttatttttattttttattttattgtatttttttgagatggagtcttgctctgtcacccaggctgcagtgcagtggcgcgaccccggctcactgcaacctccacctcccggggtcaagcgattctcctgcctcagcctcctgcatagctgggactgcaggcacaggccactatgcctggctaatttttatatttttagtagagacggggtttcaccatgttggccaggctggtctcaaactcctgccctcaggtgatccacccccctcagcctcccaaagtgctgggattacaggcatgagccaccatttccagccttaaatttaaatttaaacagccacatgaggctagtgtctatcctttttgaattctgtactcatacagaatgagtacagagaagaattctgtactcatacagaatgagtacagagcagaattctgtactcatacaagatttaaaatataaagaaacttaaacttaaggaggacctaagggacaaattcccctgtttgggagataattaaataatatttgtattggtctttgcaatttatactatactttcatgtatttcattgaattaataagaatatagaagctaaagatgaatgtggagtctccatcaacagaggccataagaaaggaatcatagccctgtgtcttcaccaattagaatgtgattctcatggagcaaagcccttactgagctatattagataggaaggagacaacagtgattaagaatgaagactctcagccagactgcctgtgctcaaaacccagttcctatttcctggctgtgtgatcttactgaagctacttaacttctctgtgcctgttttctccttattttaatggcaatagtagtagtactgacctcataagagctgacatgagctatatgagctagcacatgcaaaacagctagaacagtggctggcatacaaaataaattgctcagtgttggttagaaattaaccaagggatcggcagtcctacagaagaggaaaacctcttttgggaggacacactgctctggtcttgccgagtcctccttctgactgtgatatgtttttgcctcaggaatgtcagatgaggtctcagacaaggttctagacaagggaaagcacaatattaaacaaataataatgatgggtcttcaaccaagttttcatttcctctgataatccaattccatcatcctatcagcctaattgttatcctatttagttttcatggccacttttccttctaacttctaatgggttacaaaacatagttaagattatgagctgataattcctatcaattattaaatgttttcatgtgagccgagtattataagtgatattcatagtcagaattcttggagaccgctacttttcaccttgcaactgaggtgtattttgtattcataatccttgctctttgctatgccctggcctgttcctgaactctctctttgtctgcttttccaagcctcctctgtccccatccatctggcactcacataccccctcacttctgcttccacctctctccagcaggctcactgcttggtgcagatggagagatacttttgaagttttcaggaaatcctctcaagggcagtgaaacaatttgtctgtgagcagagatgatactgaatgcattggaatggaggtaaaatttagaatatccaagggaaaaatgcgttagttaaaatagaggatgatttttaaaataattttcaggagtaatgggaaataaagattttcaaggtgtgccagagctaacaaaccacagcatatgacaagagctcctacaattgctaagaaataaaatgcaagaatatattttattctcttccaaatacaaattcaatgatgtgctttgaatcagtacatgaaaatactcaggttgcaaagattctgtgaaaaatggtaatctctaggggcttatgcattaatccttacctgaggcatgcttttgcatgtttagtataaattattctttataaaattgcactgagcataataggacatgtagcttgtaactaggttaacaaacaatagattaatagcatttcatatcattcacagataactaaaaagtcaaaaacccaaaatattaataaagaatttagaaaacattacttcaaatagaagtcaaattcatgttttggaaaatactagtattatctcaataatttcagagggcagaagtctcaccaagacaactgaacaatgtaaatatgtctttataattcttcattttctagtttgaagttgtaaaaaaaacttcataggaagaaaaacacagtctcctgcaacaatgtgagttactaatgagtccactgcttcctcaatctcacacaacattctagacaaatgcctcagccagtgctattgagtgacatcagctcacattgcaatatattttctgatgtgtataataaattacaaatacttaataatttatcatggttgctttgagagcatcacacagcacttagcatctaactcaaaataactattgcccttctcacaacaaattccaaagccctcatttttctacttactatgctaattaacattccttttaatcttcttctttaatttatcctgtaaattttaaaatagcatcttagaaagaaacttaagggtaatcttgggtcaaccttaccagtgcaggaatctcactagcatctctaaaagatggccataaatgattttttctattctcaagactgttttatgttggttggtaggttgactactttgtttagtttgcctttgctatgagtctttctttagaatctattaagttaattgtggcattcggacatttatttaaagggcagtggaaaccaaagtgtgtaaaggctaatactcctcaatgccaaaagtaaggaagttaagaaaggtcaatcaatgattaaattgtttatcattagttaatataaaataaaggatgtatttttagctgacaaactaaattcaaggttggcactacacaaaaaaaatcacagacaactgaataaagaattaccacagtattagttatttaagacacgttcctgtgtatccatggttgatcaacacacaggattctgagaaaaattattttataaaagcatggtgctcaccttaaagagtacactatcttgctagagaaaatagacatacatattaaggcatattattgcattcaaagggtagcaggtaaataatatacaaatatgcctagagactacaaattaagtttaatgaaatgagttaagcactttcttctctccactttcttggagaggttcaggtcttacaaattaggatatgtgaaaaaagaataatagtcccttatagccaggcaggggtgaatattataggtcacataaagaagaaaaattcaaaagaactctcagaaatgaatttgtgtgattcagattgtggaggcaagaaagagagagatagatggattccctcaaatgtccgattaagacaagattggctatgaaatgaagtagagatctcaggttgtggagttatatcatatcaagaagcagtaagttaagagagctgtcagagttctagtggctgaaacctatccctatccaggaaaggctaaaaccagaatgaggatgactctgatagtgaaaagcccaagattctttctctaaggaattatgtgtgctgactcctagaaagacccatcctctcacagttacaagaatgacgccttcagcatcacaaacacagctgcaatgtggcttagcccccagcagaatgcaattgacagaaacacatttatcttcctctcctccagaaaatatttttaaagggactggattcaaagctacagaaaagcaaggggagggctcctttaggttgtacagtcaggtgcgaagagcaatgcaggcaaatagtacatcctggaaagagttaagaacatagattaaggattggatgaatgttatctggaaatttcctctagtcaggtaaaagctgaacacaccaagctctatgacttggtccagtctctgttccgttcacacttcactggctacttttaactattctctatgtagccttctctgaacccacatttaccaatcccaattaaattctcacagcacctggtgttcttagcactaatcacagcttataggtcaataactctggacataccggctgataatgtaggaggacagtggggaagtcaagggctctgtgctgtggagagaaatgctagggttcaaatcttggttccaacaattcctagttgtaaataaatgtatttcatacctcataatgttattgtaaagattaacaaccagtacatgtaaaggatgcagaaaaatgtctgtcatgtaatatgtgctcaataaatatggggtaacatcatccatggacccatgagagcaggaaccatgtctgtttcattctctatcacctctctgggactagcacaatgtttgggaagtagcagagcttagtgaatacatgtggagggcatgaatacttaatcacttcattctttgctacccattaagcccttgatatatttgttgatacatgtttactgtgtctccttattccccagttgctaggggtaagacattgttccttttgtatgccccacacaactcttcatgatgttgatacttaaacttaaccaagttctttcccaaatacttaaggagtcagatttagagaaatgtggatggaggcaaaatcccctggagttctcaactgtgctatcaagatgcttctacattataaaatggatataaaaatacatagctctagtatatatttaagaaggcaaaaaaatggtttattcctctaacttatcaactgagagtctttcagccacaaaatgtaattatttagccccactctaaatcattcataaaaatgttcagtgatgggtctccacagcatgcttatgactttttaaaattgattttaataatggtgtacatggaggttaaaccacagagttaaaaatgaacatactggcaatatctaagccagagaaatagcaatacaaaaaaattgaaaggcaaatgaataaaatatatcttcaaatgactggcaatattaaagtcaaaaaacattaaatagtatgagattacacttaagggtcagagacagaaatctcagattctttgtacctgtagttagggtcaaaagagagacagtaaacacttacatgggtcaaatgagacatgggcagaaactagaatggctggttggtaggactggatctaaaggaggtagtcttttctgtgatataatttctagctttctgagagagtctttgccttcataagcaatattacttagcataaatctcacagttagagcttaatttctttgactaagatagtgtatgtttctcaaagaggaatactttgactccttggaggtttggagccatgtgtcaaaagattgtgcaaagccacaggataaacatagcttattttcctgcaaattatgtttttcttaaatattggaagcatagggagatgaacgttttaactggtagtaatttagatcattcgtttatttaacaaatgaataaattatgctgtagaatgcaaatcttgtacatgtaaagaatgcagaaaaatgtctgtcatgtaatatgtgctcaataaatatagggtaacatcatctatggacccatgagagcaggaaccatgtctgtttcattctctgtcacctctctgggactagcacaatgtttgggaaatctcagtagaatgcaaatcttgcattctacatttttaaaaacaaagcatgaaactacagagaggcatcatgtttgtgtagatcactttagggtacctagggctttaggttgaagagggaaacttccatggcaaagacgcaaaaacaagagggaaaggaaatgaaggacacaaagacacagttcactgttttggctgagacccagaactccttagctcagaactactaacagcaaaggtggcagagataccatggtagagtctgcaaaatgcaaacttactagaactggcaatcttcaacacctaggcaggatggcagcaactaaagctcacaaaacactagaaaagtatgttatcagagttgaggagatgctatgtggacatgggggaggagaagaacaatttcaaggtctgaatgagacaaaggccagagcatcagatctgcagttacttgtcaactcactgaatggtgagggatgcaaaggcacaggtgtgcacactagcaaggttcagaagtgaattttgacaattgtgtgttagagatgataacagttcaactgagatgacaaggaaattgcttatagatgtccacatgaacttaccacatcagaaaacaatacatatgtatacctttgaaaccacattttccaaccctactcactttcccaggcttgatgccacctctgtgttttcctcctcctctcatcctaaataaaccttgttcctcaatataaactcagaaagcagtttcgtctataggttcagtgttttcaggggcagcagagattcagacagggtaagctcatcatttttacctcttcattcaccagcgtaagtgtgcttgctctcagacaaacattaccactaccaagcctgaattactctatctgggctggcaacaatggcagtattaagaaaagataaaaaccatctaaatcatgctgcttggaactagttataaccacctttccagacacacagatacgtttccatgattaaagtataatgtggttggctgaaaggaactcagaaaatgatcgatatttgaacttaaaacgtttgatcacttgtcctgtgattttttttcttaaaactcaactcacattgtatttgtaagaacacagggaaagagctgagtaacaggacctagaggagatttttctttcctatcacttttcatgatggataggctccttaggaaagagaaagtatttaagggcttgccacgactccagtcatgttttaacctcattttataacccgtcaataggattgtgttacagactatctgactccccccactatccgctgttcactctcccttttagttatagaattccctgaattttatttaggcaaatggctatcccactggagactacacctccctacttccaacagccttctttgcacctcggagtggttaaaggactaagtcttggccaataaggtataactaggaaggatgtgtatacctttcagctcatgtttcctaaggacaatgttcaccctccactttctctcccacttgccccttcctgcagactggaatgtgagcaggattgtgggagccagtttcagtgctgcagctgagagcaacccccggggactcagcagagtaacaaacagaaggaatcggggctttctctaatcaatgttgcagagaagaagtacccacccatcctgggccacctacccaccttgattgagaccattgggtaaaaaagaaagaaatttctagcttgtttaagctactttcacaaatctctgttacagcagtttagcctgtattctaatatacagtttctacctagaagtgggtattgccataacaatatctgagaccagggtcacaggctgtaaggacagagatacagatattgacagctggaaagctgaggactcctgctagaaaagccaactttttctgttccccaagcagtacaaggtaagactgttgctcagagcatccttcaagaatctcctatattctcctaggccacacaatggcagccagttcaaacattcaggtagggcaggcctggatttcccattcgagcctattgcttcagatgacctcaaggaagaagcccttaaactgagggagttaggagtgggctaccaaaccaataaataagctacaaagccaataaatcaaaaggtagttaaaaactacagccaaaggctactttaatgtggaactggaagcagacagactggaatttttgcgggtattacattgccaaagaaaacaaaaacctggctgacagagctagtgactgttgaatcactaaaccaaatctcaggttcccaaacctgcaccagtagaaagcaagctgtacaaggagggaagctaccaatgagggcatattatctaacacccaccacagatgtggccacaaaagacagaggccatcaaggacaatggacagggagttatacccagagagtgagtttggattggccaagatgacctaataaagactgccaagtagttcttgcccagagaaatgtaataacaacaacaacaaagcgctaactcctactgactagattatgctgtttgcctcctcctcttttccctttccaagtagggatttcatggcagataacttgtcctttagtgccggggtcactggaggcacatccaccctgatagagaggcctagacatatcccagagacctggactctcagctgggtgcagtaaataaatgggctttggtttgcctctttgggaagaaggtgggcatatcctctacgtgggatgaagggtaggaagggatacttagatgctagggagacaagctgtgaacagagactattcattatctcccatgtccattcttctcttgtccttttagataaggaactaccagaaaggtggctcagtaagagcctacatttcataaccccctcttgtagctaactagacatggtcatataactacattttggccaataaaatatgaattttagccaatggtatacatgtttataaaggaaattttttgtccttaactttctctgtcccttccccttctctgtcccttcccccttcccatgggccagaatgcagatgtgaaggagggtgccaccactgagcacatggatggggacagttgcctggggatgcagagcaatgagacagaacctgagtttctggtgacttcatggagccaagctgcctaccctccctgaaatgccttcctaaacaacatctatgttgtttgaagtattacattttgacatctaatttttacagctgccaaacctgtaccctaattaatataggagaaaattggaaagcaaagtggtttgagtgcaaagtctatatattgtgtatacatatgcatgagctaaaggtgaggacctagaaactgtcactttagaaagaagaggtggttataagataaagtagtaagtgcattaaaatccagcattcctcaccaaagcatagctaagaaaatccatttgaataagtaaaactatattcaacttgaaaacactttatcttaaaaaaagaattgtaaaattaagacaattttcttctttttcaatagtttaaagctaatagtaaaatatcacttgatcaactcaagaaggaatcccataaagttatctgaattgataaatggttacatgtgcaaatatttagtaacaaatatcagaaaataaaatcacatagtatacaggcagttaagtgctctgattctgaaaacagatggatcgtttatacatcctagttctcccaattacaggcaacctgaccttcagctacttacctagactctctaagcctcagctgtctgtgcttcagtttcctgtggatcaaatgagataatgtacaaagcacttggggcaatgcccagttcatagtatgatttcaattaattttgtctaaaatcattgccacctgattgtaaaaatatctctatcaatcagaagatgggcatcttaaccatcattgttctatgagactgacctctttctcaggttggcaagccataaaatgcccagtgccttgagttttaatgaaagacaccaattcaatcagggcattcactcatttaccatgtgtattgataccttagcatgaaaagcatgatcaatgtgataaaataaaaatatacttctaggtttgagaagccaattcccatgtcacccttatttagctgagtccacctaaataagaacacccagtctttgaattatcactccctaattgactgatattggacaagtctccacatatctttgagactaggtttcctcatctataacatggaaaaacaatatctccctcatgggttgctatgggtattaaatgagaaaattcaagcacctggttactactatgcctagaaagagtaagcattcagataatggatgacggaaactttattactgctatagttatggctacataaaatagttaaatacctcatcataagaaaattgtgcctgcatgtatttgagacccactggttgtagggtaaatgctttgtgctatctgtctcatcatactgatggcccatactgaccacacatattcattctctcccaatctcagtagataccaaaatgctatttttgcaagcctgttgtccagagatgggatgtattcatgaaacacagacttcctccactctgtgaagtcaaatagcttgcatgagattgcatccacaacattgtttcttattagtgtcacattctgttcaactaagttgaccactgcaggctaagtgataattacagcaatgtgtgtcatccagtatcctccaaaacttaatgattttacaaactaaaagtatatctgcaaagaaaatgttatcttaaccttcagggagctgattgggacaatcagtgtaatcattttaccaaacatccagggtggaccaggggcctttatctttcacctgtaacatgaagatgaatctgaaactaaagcacatgcttgaaactgaagggaaaatgagtctttttcttttccggattaaaatagaaccttcccactaacccccacctgcaattccaattatttatcccatttctatcagggcagaagctatttagcatggcttatttaatccattgttttatctttattttttaaataatcaattttgccctggctaatgcatttacagtgtttcctcttgcaggtttctgatatagtcaccacccaggtctgacctagttttctaagctgatttttctcagccatggagcctcttgctgagtggcttcacagttcatctgcttccattccctaatgccatggtccctgagaccatcttggccgcatatggtgggcactcactggaatggttaaaattgctaccctcttcactgaggcctcagaggagtatgtaggtccaactcacactgctcagcagtgtcagagctaagaccagaatccatcaactttgttgtcaccatgtagacaagagcccttgatcctccatcactcaaaacaaaattaaagatgagctcccaattgaagtgttctactggtaacctcatataggcacagacttattccagaactcctggttatgctataatatcccttgctgtcttctatgattgtcatttggggtcaatttgttgttgttgttgttccttctcttcctttgaggatgcttttggatttgtccagctggattgtttggtccttggctggttgtcccggctaagagcccagcctggagccagtgcccactgtgtaagcaatgcagatgacattgtcgaaaaagggactctgtagagcattgtttgcttagttggcccctttctagctatctgtttgcaactaccttgataaaaaggtgctgataatgagggacagagttttatacattttagttaatcatctccgcagcaggtttttatacaggatggtgatcaatgttgaaattctacctatctgcccacactgactcattagtcatgagcatttgtcatcatacatggggacttcccagtgccctgcactgctttggccatgtgcttaggaaacactgggccaaaggacatctatccagtggacgttttcaatctcagcagaaacaattctaattctgcacttcctgaaataaaatcttgccataatcaaagcaagaaaattaaatcccttcctagaaataaaatatacttatttgaaagtgtttcaggccttgcgcggtgactcacggctgtaatcccagtactttgggaggccgaagcgggtggatcatgaggtcaggagatcgagaccaccctggccaacacagtgaaaccccatctctactaaaaaaaaaaaaaaaaaatacaaaatattagccgggagtggtggcgggcacctgtagtcccagctacttgggaggctgaggcaggagaatggcgtgaacccaggaggcggagcctgcagtgagcggagatcgcaccactgcactccagcctgggcaacagagcaagactctgtctcaaaaaaaaaaaaaagaaagaaagaaagtgtttaattagcagacaagttcgtgtcatttttttaaatagttaacttttacttccagaaaaatagcaaacaagataatactcaaatgcaaccgtggttgcagaatctataaacccaaaagtctgagagatttacaaataatcaatattataaacaaaaatcacatctacctagaaacatttcttttaaaaaaatctgctggcaagtccctccactcttacctcaggtgggccataaatattttcttccaaatatataggataaccagaaactttctctttctttaaacaacaaaaattggtttataattaaaatgcactttggcatacctttctgcaatattttcctcacttgagttggagtaaaaacttgagagaattagcaaagcctgttaacctcatgaattgggtagtgaatttggcaaggtgacttctccagactttcaaaaagaatcaggcaggaaaactactttctggatgttttgattacatgagcaagcaaatttccaagcatctacactcccaataatcaagtgatagtatggaaggccatcgttactatattgagaacgtacctattttttaagtgtcaaaactgcccgataatgaaatacttgccgtgtggtccaagataaccacctggcaggcctacatgctattattttttttccattctgcatgtcttttgtcctctcttctttatatcacttgcccacttcagactatgaaagttgcttgagggctgagcccatattgccaataattcattataattggaagcagtgggtgcttaagcactcattacctgacaaggaacatcacagtaacaagctcagtttagaggtcagtgttaacaaggccaaggtcctagacctgagatgggtggatgtggacgtttgctctgctccatgacaataagccaaataccttggtctgtgctactgctcgcccggcatgcagcagggaggtgcagagcatgaggagtatgtgaatgtcctagtccaagtccccagtgcagctaggattggagaagtataattaaatattgctcagcccagaagaatcagggtgtggtccaggtcagaaacaggcagagtgaagatgagactcaccggtgctaacctttctttcctttgctaacacattcaagtgacagccacacttccaccagtagcacagactcatgagaactggtcattaaacagagagtactctcactgggcaggtgaagggggatatgtccattattgtgagaggttcatgttttgacaaaaggatcctgatactgatacccaatactgagttgaaattcagtcaagtagagcggcacatatgaatcacttggggatcttattagaatacaaattctactcaatatgtctcaggtgggacctgactaataagctcccaagtgatgccaaagctgctgggcctttggctctctctttgaaaagcaagattctagattttatcagatcggcaggtgtaagggaatcctggaccccatgaaactggaggttcagaaacatctgaagaaactgacaaattactaatggtcagagtcaccaagttttcaggaatccagagatcacaccagtcacaatcactcaaaagatgccagaattcagtcccaaccagtgccctgggtttctgagtcccttttttctctctccactacccagagcaagcagccagggactgtgggacacatggcagagccctgatcttgtgggcacaggcagatcaaagtagctaaagatgatgttaaagagacaggtgtggtaggcaccaataggaggctaggaagtcaaggtcctccaatctcagacccctgtcttaagggtaagatcaaaggctggcacaaaacttacagatcattttatacaaaagttggtatatgcttggggccttgtgggacatcttctccatatcaaatccattaaatcattggcccagactccatttgtctttaacaggaaggaatagctcttggggtgattcaaggtgaaaccttatccatttcttccctctctctcattgacgccgtgtatgtgcaaggtggtgaggcagccgaaattaggactatagagtccttcatgttcacagaacaagtgctgcaaatgggtgtgagtcagccttgagctcaatcgagagtaaacagacaaatttacattcatatatggatttagacatttgtcaaatatttgctaaaagagcatttcacttgtcgaaggaaggcatagccttaatatttttctttctttctaaaggactcgtttcacccacgtgcttgatgaaagtttaaatataaaatgcctgagatgaaaatgtatattaatatttttctgtctttccaggtagatctgctgacctccttcttgtgctaaatctattaacaagcaaataaagctgaggtccttagatcagtactatagccaagagatactaatagtacccatcaaaatcagatgttaagcctgtccagagagctcctggcaacctgagagactaagctgacatgggcattcctctgaccaccaacaatggaaaacaggatcaaacatatccaaaataaatcttataatgtgatctgaaattaagagaaagataggaggttctcagaagccatgaataaatacagaagtaaaagtcaggaatatgaggtggacctgggctgcatgcgacatcccaaaggtgtatttttcaagaatacaggccctagaggctgggcctggagtcctggccttgggctgtggcccagcagagaacctaaactagatacttgacccatgagggctgcacaggctttgaggagaggattgggaaacccccaacgcagcccagggggctgaagcaaagcttagtttctactgtaaatatataaattattaaagatgttaaacagtagtcaaaaagaggtttagaagtgagatttgccagaatccatcttaaatttcaactgttccagaatatagaaaaacaaattagccaaagtttctgttatgacctcaatacccaaaagataacataaactaagcaaaaagagaaaccacagactgaaagagaataagtgaatgtaggtaagacacagataactagtctccaaaatacataaagaacttacaaaagtcaggaaaagaaagccaaacaatcccatataaaaatgaacaaaggatatatattaatacttcactagcaaaatgattctaaaatctagtaagtagattaaaagatgctcaacttcaataataatcagagaaatgtaaaatgactaacaacgtgatgtcatttcacatccaccaggttgagaagtattaataactcaactgtgagttaagatatggggaagcttttatatccttctggtgggtgaggaagttggtaccaatcttttggggaagagaatgaaaatatctagtaaaggtgaagatgcagaggccatagatctataaattacatgtgtagatgtttactctagggaaaccctgacaaaggtacacagggagccatgcaagaatgtcccctgcagaaatattcacaatcgcaaaaaaatacaaaacctaaatattaataaataagcaattaataaatacatggtggtatattccaatttatagcattttatttctttataaaaggaaaatctctatgttacaaatatttctattacttaatcagagtgatggatatagaagtttttatttgtgttttctgtattttaaaacattattttatacaggttgagcatccctaatctgaaagtttgaaatccaaaattctccaaaattcaaaactttttgattgccatcatggtgtcacaagtagaaaattccacacctgacataagacaggttgcagtcaaaacacagtcgaaactttgtttcatgcccaaaattgttaaaacatactgtataaaactgccttcagtctatacatataaggtggacatgaaacaaatgaatttcatgtttatacttgtgtcccatccccaagatatgtcattatgtatatgcaaatattctaacatttgaaagaaattgaaatccaaagcacttctggtcccaggcatttcagataagggatatacaacctataattaacatttaaataaaaatatattataaagtctacctagagctatacattttgtcaagggaagttatatctccccatccctatgtagagatgcacacataaaggcctggaagaatacacagaattattaatagtgtaacttagggaagaaagtagaacagtagaagaccaaagaggaaattttccctttactctgcctaattctgtgtttttcacatatttatgaacacatattcatgtgttcaatgtgattgcagtgaagcctcaattaatgtccttcctacatccacaccctttgccctgtaattttgcattcttccttctgattctggctggccctgtgagttggtttggcctacagaatacaaatgaaatgttgatgtgccaactacaaggttaggtctcaagagactgtcatggttttccttgatctccctcttgcagttagacttaaacactcttagaaaaagtctggacttggctaggcatagtggctcatgcctgtaatcccagaacattgggaggccaaggcaggaggttcacttgagtccaggagttcaagaccagcttgagcaacatagtgagacccccccatctctacaaaatattacaaatgtagcccagtgtggtgccacctgtggttggagctacttgggagactgagatcagaggatcacttgggcctaataaattgaggctccaatgagcctgagctgtgtgccactgtacttcagcctgggtgacagagtaaaactcagaaaaggaggggaggcagaaaaggaaagaaaaagtcaaaagaaaggaaagaaagaccaggacttgccagctggatagtgataaaccatgttcaggagaggctagttatcctagccaaagctattctataccaacctgtagatacaagagtgccaagtcatgatcaacagatctgcctacctgacccacagtgactacagacccaaactgagaccagagaaatatccagcagacctataaactcatgagcaatagtaaatgcttattatgttaagccattgagttttgggatggttttgttatacctcaatagttaattcatacattcatcagatgtaaaatttttaagagtggaaaacaggtccatccatttgagaaaaggtgacctgctgattcatacctagacacaatatataacaattccaagcctttatgattcatgtcatcattagagtttgacatcagaacttgctctatattgcccacacactgtccagtttcttatctggaagatgtgtccttcatcttccatgaagctggagccccactaactgaggcttaagtgggttattttagcacatcttctagcatggtgtgtcatgtcaagtaccctttatgaggcttcatttactcttcatttaccctttgtgatgctattcaaattgatgtaggaaaaaagacaacaaacaacaaattgtccattaacttgtgctgcatttggcaggaaagtccaagccaatatgaacataaagagtaatcaaaggtgtttaatatgtcattaagtattctccgtactgagccaactgtgaaacagaagcttggagagtaacattaatactttgccccttgtatatattatcagtcaatattattcaacatattgttttagttgtagagatcaaatgcttggtgcagcagaagggtacaaactggagactccagaggctgcattctgcttcagaccagtgctgggattttgagcaagtaacttaatttatattttaagtataacttgtttatcttaatgtatatatattgtatatatatgcacacacatacacacatatatatgtatgtgtatatatatacatatatatgtatatatgaagtaaagaggctattggacttatttcttaggttcctcccaatatgaacattccaagagcctgtgacagtgaaacaagccccgaggccttcctatcataaaacaaccttttcattccattttggtctccatagatttcagtgtcctttctctcagtcgaaatcactcacttcaaaaacttggactaacatcaagattttagccagaagcaagctgaaaagtagttgccattggagactccttaatacctcattgttaaactggctaatggtgctctaaggatgagccgttagaggaaatggtcaagatcttcatctcaagggtgaggaagctaaggtcctgaaaggtcctgtgatttgccaaatgtcagacagcatcctagcaaagagggtaagttctacttttaaggtttgtgattccagatccatccgttaatccactcatgtaagatttgtcgaacacttacagacactatgctaggcgctagggatgcacagttccaagacaaacctgttgccctcatggagctcacagctcggtggaagtaaaaaataagagaaacactattgaatcttgtcacacatgattagacaggaatttatgggatgctctgagaatccagaggaaagaataccttactctgcatgaagagacagggaatttttcatggaggaggatataattgagctgcattttgaaaaataaggagttttgaggcacacaatacataagaggaaagggcacagaacacaggacatgcaaaggcatttaaacacacaaatgtacacacagatgtgtttgggagactgtaagcagctggatatgcttccatctaggatgcaggctgggaatgtcaggaggcataaaggaagaaataggcaagaacagatgatgccaaggaaaggagttttgacttttgtctagggagatgaaggagccactaaaagacaggtagcaggcatggctatccttgctttcaacagacagcatgtccctaaagaagagaagatgagaggacccagttaggaaaggaaggatagcagtgggcggctagtccgtgcctgctgctctttcctctagtctctgttggatttccttcactccagcctcaatgtgccattcatcatcaatgacgccatcccctggggaagcgctgtagacactcgggattctcagatgggccagcccaaggaccacagcctactgccactcatggctggctcagtgcgtaaatgctgtcctgaacccaagagaagcatgaacttgggggaaccccagagacccacagtaagattcaaccacagatgagtgtggttgagtgacactaaggtagtaaatattctaacagatataggttaaatttcaacaggtggtttactaacttggtaactgtgtgacttcaacaaggttatttcacttctccaagtctgaaggtcctcacctatcaaatggagataacactaacacctaccttgtatcctggatttattgaaagaaattatgcaattaattatatttcatctgtgcattcctggaacatggcaaatactcagtaatccataattataattattaacatttagcatcatgcagtcaagcaccttgcctatttctagagaagcttggaacctgagacatggtcctaaaagaactctcctcaatatcacactcccattctctcccctccagagacctcgaagacaaaacattacatttaaaggcctcttccctgatccacagcagcatttcttagattcttatgaagcatatttaggttaagataaataaaatatcagatctacccttggagtagctaataaaaaattttaaagtgattttcttccttctacctccaagaagaccctcttttaaaaggtgcaatgagtaccagaatcaaaatatatattacaggtttatttttcatatggcaaaagcagtatgcctatctctgtcctcgaatatctccatggttttgtgagttaagaattggagttaagaatgtccctttagatggaaactttgctgaaattttatccactcatttattgcccacatgagtttaaaaatgagaataaagctagatcttttacatcactggaaattttcttatgtctcagcaccatccagaatgttggcaatattaacagaccagcaatacttcttgcataatggagccagaggaataaggaagggtggggaggaggaagggagcagaggagagctttgggagactttccctgactaattcttcttcaaaactgtgaaacttacaatttctaaaaaccatagtcatgatgaaaatgcctcctttaaaactgcagccttagaggaagcctgtaggcttctgtcgagtattttagatcaaagacgtgggtttgaagttgaggttaattccctcactttgcagtaccactaaaatgaacatcacaaataaggcctgaaaagcaatggctcgattccttgaattaactctatcgtttctaggtaagtacttggaaaacactgcatttacaaaatatatagctggttgaggacccaggtgattcaaacattaaaatttactgagatttctgcttagtttgcctgtctgcttattcaattttgtttcacacttgattaatcagaccttaggttgaaatagccaaatgatctgatagagctttctggtaagaagaatagtactgcagaaaaatattcacaataaaaattgagatgaatgattcaggtatgtggaatataacattctgtttaaattatacatctgttgtcaaaagatacatactttgtaaataagtatagaaaattatctggaagaattggtactagtatattaacagcaactttctctggttagtaaaattggggatcattttcattttatttttatctatttctctctctctctcagtatcgctttgaaataaagacagctatttttttaattccaagtgttttcaattgtgtatataaaccaaagcatcaaaaacttcagcttagagtaaaaattagtacatttaagagcaattggaaacacaataatgattatagccagttttagcttccatgttccataccccatgctaagcatttcccatggcttgtctgtaaccctatgaggtaggtattcttatcattcctattgtataaattagagaaacttaggcatgaggatgttaaataacttacccaaattcaccgtactagtaagttgtaaaagtcaaaaacttttggtggtccagaccatctgattaacttctattttgttctacctggattgatcctaaatgcagcagctacatgtagcagctttgtccaagtcttttttttttttaactgtcttattcttgcttcttttataataatattaaacttccttagtctgttaacgtggcacacctatctgcaagggaaagtggtacataaagaagatattgtcatatatctccaaaatggagtacaataatgctgtaaaaaagattaatgaagatctctttgaattgttacaggctaacttccaggatgtactgttaaggtaaaaaaagctaagtgcaaaagagtatctatattatgttactccttgtataagaaaagtgattataagaaaacacatacataactgcccatttgtacaaagaaaatatggaaggaactcaccagaaactaaagaaactatctacagagggcaggtgtcaaagagctggaaagaagacggaaatggttatgtgtatcaagacaggatggagtgacagatactgccttgggtgcatcattttgtaaagctctggctcttagaaccacagttatgattcatatttttcacatgcccctaagcaatcaacaactaaaactaacaatgatgaggatccaaaatgcaatacaaaaataacaaataagcctgttacaaatgagttacaaaactacactgaaaggatggggaatagtaacactaacctaaataactacagaaaacagtatcttgactggataccatgaagctaaagacaaatacaaatgcataaatgctagaatttagtcagtaaatatgtttctcgcaggggcataggatagcaattctaaaactatgtgttcactagaatcaaacaaagaagtaaacatatcatggaaaataagcagatttctcactatttgagaaataaattacaaataaagacaggaaaaagctaaaagtgaaccctgagtttacagtatttagtataaattgtatagtacaaatggctttaaatatctatatagacatatagataaagaaatatagaggtgtgtatatgtgcaggttattcatatgcatatatttcctggctctgcctgctgagaaggcttagagcaatgacatcccagtagtaataagcacatctagcatgaagatctcagtttctaaacaccattctctgatttaaaaaaaagaaagaaagaaagaaagaaaaaagcttggacaagtgattgatttcaggactagagcaggaggaaaaaaataagcttagaatatagtgtgaagcaaaaaagtaagaaagtgttcaaaaaaataaataagggcttaataagagagcacaaacactaaatgaaaataagctcctaacagccaaagctggaacaaattaaacaagttaaataataatattagaatatgacccataaaaccaaataaatatatataagttcatacacatggatataaataatctattatctaaataggagagaaagacagctcttccatggctgtagaatcccaattaatacatgttgaaagaaagaaggaagtggaaaatcaccattaagcaaacaccataataacaattgtaactagaatcaaaatccatggatgtatgctgaaatcatttgttcacagtctaaagagaaacaggatttgcacagtcttaaagcatgtcccccaagatctttcttaacagtaggagaaaagatactaactataaagtggagaacccagcagaaaccaccttaatcaagtggtcatgatcaacaccaccactaataaaaaatattggcatcacaaatcccatgacatgatgtgctgagaagaacacatcatttctgtggaattcttgccaaaaacacataacctcaaaccaagcatgagaaaacaccagacaagcccaaattgaggggaatttggcaaaataagtattctatactcttcaaaaatataaggtcttaaaagttaaggaaagatgagaaactgttacagatttcaggagactaaggagaaataacaacaaaatgtgacatgggatcctgaacagaatcctggagaataataacaatgaaatattgatgaaaaaactggtagaatttgaataagatttttgtttaattattggtattatatcaatgttaatttctgggttctgataattgcactccagttaagattttaatactgagggaggctagggcagggatatgtgaaaattctccgttccatttttgcaacttttctttaaaagtagtttgaaatttaaagttaaaagaaaaggtattgcctttacttcaacataattaaaaatgctttttggaaaagtaaatctcctttgaagagaaagaccaggttgggggagaaaaaaaccactgatgtgaaaattataccggggaaaccacactttgttaagtttccacttttggatacttatgatgacttaagaatctatatcaacaattctgtcccttgaattcaacacactgaggttttattcctcagctataatcgatcttaatttttcagtttcaacagaaagacatctttccctcttgcaaagaccgtggccttaaaaagcttttgtcatttctcagttgtttgcaactccaacagtgaaataccgccactacatttgatttttggcttaaagaaactctattgctaagatggacgacttgggcagtgtatttcacttttgtttgctgatgtgttgcatttatttgctttcacttatcaagaaaagagccaagtttttttttcttcttcttctttttctactcctccacctcattctctcctgtttaaccatgtgtgtcagaaggagagctatcaaaaggaagctatgcaagttaatcagtcagggcctgagagtgcccaggaaccgtttgttacaacagcaaagggaatgaagcctccaagcaacaaactaattaatacctctctcttctttgaagaaaatgacccaatattgaactccagtggattatacaacattttaatttactatctgctaaatggatgactactttataatatgcatttctacttattcatttactgacaacaccagtagtcattcaaattgaaccccctggccaaggtctaagagaaacctaactaggactagaagatatttaatatacactattatatactcatgcctcttgtttctaccaaacgagatgccatatggaaagaatgttgcacaacgctggcacacagagcagccaggaacttttccttgttgctttcttcttccctgcctctacttctcttcatgttgttattggtaaactgtttgctaagatgtactttccagataacaattcagaaaacaggtaggagacacacacccttagaaatatcaaaggcaaacttccttggaagtcaagtgaaaaactgctgaggagttaaaaaggcagcatggcaaggtcataaatctcactttattgccagtcacggggacatgaaaatctgaagacccttaagcctttcccctgaatcctaagacagtagggctacatgccctggaaataacttctggctcaaaatggactctgcaaataatccaatgtgttcctagggttgctaagtctagcaaatagcaatatagggtgtccatgtcccaggcgatatttgggacatacttatactaaaaattatttgttatctgaaattcaaatctaacctgtattttaattggtatttcccttcccccttatgagaaataggtgactaatgctacaatttaatttccagacctggacttttatatagattcattactttctaactgtgctactgaagcaatttaatgtccttactgtacatgtcctcatctgtcaactgagataataataacaataactttctcatagagtggttgtgaagagtaaatcaaataatctatacagtacctggaatatactatgtattcaatacatgcttgcttttattgtaattactgcagtattactgtttgcattaaaaatatttgttgaaagaggaaacaggttaataaacaaagtttagattttatcggaaagacagtatctttgctaagcaaggtagagaaagaagaagagtctgtgaataaattaagaatctctaaattacactgtaagattttcctgtaatccccaaataataattactgtcaggcttcagaatgaggagagcttgcagaattttcttgcagtgttttacacatttcatttttcatttcaattcagaataaaaggcaaaagaataagagtgaaacaactaagataagcccaaacaaaaatgaggaaaaggtgtatatgtaaattaagaacacatttattactagccttttttaaaaaaggaatgacagtgacctctagtaaaatatttctgtctagaggcaagattacccatgcctggataacagccaatgtttaagctcttctcttagaagtgtcctatctacctctcccaccttcatttcttcaagaagtcagctaagaacccatcaacaccaatacaaaggctgtaaaataacattttcctcttggctggatgcaaaaactagaactgcagaaaagttctcaataaaaattgtttgaatcgctatcaactcattctttctgctgactaggaagttaaataaataaataaataaaagggactccaagtcaccagttacgccagcagtttgcaaaaactattctctcttttgcaggagcaagggtcaacataaatgatttattgtctttatagctagtatttataggtatttgagggtgttccataggctcaaatgggttccttttctttatctggcctcaagagattaattattcctgtcaattcaaatctatcttcctgttaacaaatcccaatgggtcttttcccctactcaatcagataaactccagattctaacattttaatgatttttttctgcattacagtgctgcttaattgtatagtgtttaaagaatatgtggatctcgataggagtttttttatttccttaataagagagcctgacaactttgtcaacttaatgagtacacactgatgtttgctatgggggattttcctagtgattataggacttcttttctagagatgatattcccattttaaatgtttttttaaaaaagaacttggatggtcaagttcaagagtgagtaaattaaatggcaccctttgcacatgtatatgtgatgtgtccaacagaaagcacgaatttgacgtgtccaacagagagggaccaattttggtatattatcaactacctaaaatataaacagcactttaaagctttgggaacaaaaatgtatatgtaaaatattttaatctatgtttatcactctaaaattgggatactgtcagttttaagaaaaaggagaagaaacatgcatatatgaccacctttaatgtttgaaggtgtccaaagaggcaatgatgagaaaaaaagatcatgtattgtggaattacaaggatccactatatcacttactattatattatttctctgagcctcagtttcattggaaaaagacaaataaccaagcctatctcaccagttttgtttgattacacacagcattatgaataagaatagtgtctgacagtaggtattcaataaatgctaagtttcaatttgctctttttcaacattcccttttttttattatactttaagttttagggtacatgtgcacaacgtgcaggtttgttacatatatatacatgtgccatgttggtgtgctgcacccattaactcgtcatttaacattagatatatctcctaatgctatccctcccctctcccccttaaaatgaagagagaactgaagaggctacaacttgacttctttattattttctaatactttcattattaacctgacaggaacatgaacagggaaaaacaataagcacaaaataggaagagatcaatagcttgtgatgagaagacatgaatcttgtcagaattcagcatagaacacatgagaagcaaactttattctttcaacttacaaaatttatcttttcttctgataatggaacatttcactcaatacagagccgactattaccatgaattagttataaacacagatgtagaaaaagaaaaataatctacgcaatgaaagaccttctaatgagtacatgaatgtttttcaactctaggtaacaaatcagaagcccagggacaggaccacggtgtgaacacttttttaaagttccacagctgattctggagcctaataaagttagactactacactggtacagacatagatgctgcaatgtatctactacattgatgtagagggagcttgtgcctggaaggtaaggaagatctcaatcacagagttaaaaaaaaaattaataagcactaaagcatggtaactgaaaaaaaagtcaaaaacctttaatataaaagtctcttccactttcccccaacaattacataaccatgaggtctcttcctgatggcagcagcagcctgtctggagcagctgtggcagggacaccagctgagtggggaaggctccgcaggaataggtgggagccccatcccctaccgagttggagtcccatgcttctgggcgcagctgcagccacccagctgcagctccagactgggcatccctgctctctcaggggcatgggagtaccccacgacccccgcaggctcagaagtgcctgctcctgatccctggcctctctctgctcccagcaccggctcgagtgcagagtaaagttgcagctgagcccaggcactgttgcaactcagctgggtatgcgtgcactgaaagcagcactgacatgccaggcccctgctgcctcagccccctctggactttgggcaccaacaagcataggagggaggctgggggatggcggtggctcagtgtgggcctgcaggcacccctcggcatgaatagcctgggtaccacgaacagaggcaggaagcagacaggctgagagcagaaaggggtggatcctcgcccacttacaagccagggatgccctgaagcccgggggcagggctgcccattccaggtggagtccgcagccagaagtgacaacttaggtcctttttctgggcccatccatggccacccatggaccaaccagcacacacttcctcccttctgtgcccataaaaactcctggactcagccagtcttagacagacattgggattaccaactgcaggaaggagccacctacttggtgtctcgggtctcaggggtctcctcaacttgttgaggtgacctgcctgcagaaaggagctaccctcctgagagctgctttgttgctcaatgaagctcctctctgccttgctcatcctccagtagtccacatacttcattcttcctggatgtgggacaagaactcaggacccaccgaatggtgggactgaaagagctgtaccacagacagggctgaaaaacgccccccactcaccacattgcaggcggtgagaagagctgcagcccttcggggagcccagacctaggggctccctgagccaggggctctgcagttcctagtgtctccaagctttcaagtgccaccacgttccacttgcccaaataccagtgcccacagcagaagccgcttgcggtatgtctggtccagccgcagccttgcacagagctggcgcctggagctgcctgccccactgcggcagccagcgcgcctggctgtgcgcagtggctggatccaacgctcgcttgttcacacaccccctgccactcctcgcccggcccgcccttagcaggtgtgggatccagactggtagcgtgggccgagctcagcctatcaggacaagtgggcataacaggccctgtgggagcaagtaatactcaggcagaaggcaccacccaccactgaggcttccggctggcaaagtgacaccccaaggatcctgtgacattcccttaaagaataatctaaagggaaaagatccaaatctattattatattaagggttttctctacttcttccccgctctcaatctcatgtgcagatataccaaataatcaacactctacccagtttatttcatatataagtacattcagtaaagctgcccaatgttatcaaaactgtgaggggttgtaaccatcacaaaggatatacttaaactcatatttcattttgttgactctctaacaagcttcagaaacatggaaaaaatttaacctgggtagaaggaaggagaaatctggaagataaaaggagatgaggccaatgagctttaacagagtaaccctgggaaaaagactttgaagcagagagtgaagactattagctgtaatacacagggtcttgtgaatccacaaaaattttaaagactgacttggtagaacctataattgaaagaaaaacaccacaataataagaggcaataaggacagtctgcagagagtagtgcccaatgctacaatactacagaaagaaaactacaattgaccaaaccagacatggaagtccccgagctaaagccacattagagaagtagaagagagggatagaggagtgtttagaagcaaaatttggcagcagtgaacttgaggaataaaggagatgatttaaagactatttttgattgcttatttgagagataataacactgtacagggtttagaagtcatggaaatttatatattcatcatatttagcttgaacaatggaaatgggactcagcttttgcaaggaaaatgtatactttctggggttgacaggtgcagagatttcaagcaaaaagggctaccttcaagggaaaaaaatctaaaactcacctgcaaaaatttgcttaccaattattacttaattatttgcacacatttattttttcctttaaaggaccctaaattccttgtggtctttgcatcccccatgattcctagtaaagcagtaggctcagatatcttgaatttaatttgatcctaagtcataatttgatcagaagccatctggcctgggttctgaagtcagataaacctaaggcaaaaccagtttcatcacttgttagctgcatggcactgaataaattaattatcctctctaaactcagcttcctcatctgtaagagccagttgttgcaaagattaaaagagataatgtgtatgaagtaattattacaatgcctatcaaactgtaagcattagaaagggtagaatttattatttttgttattgagctctttattttttcttcacacacacataatccatagcacctgatgctacacattcatcagccagccagaaacccaggtaaatcaatgaaaaagaaaacgacactaatcaatcttccaatttttctactctgacaagattctggcaactagtggtgagggaaaaaaaagaaatctcctgcaaatatatatcatctttgtcatcaaaacagactcaggtaaagtcacaattagcataagtctgtacaaatgaaaaccaatttactaatgcaatactgttttattcaggcttcttcgaaaatccaggggaaaaaaatactccctctaaaaaacacaattcagatgacttgggttttgaaactatgcagaaaacagaaaaatagttttcattatcaaaaggtagacaatgttttgtttcaacaagaatgaacaaacaataaactaacattatggcccaaagactatactattcttagaatgttggtttagaattgaataaaacttattgtataaagtaatatgttcaaaggagatcctatcaggggagaaggagaggcaatcatctttattttgggcagacataagaaaataattttgtagccttagactaatacctagatttggctttgttctagacccagaaaaactatttttggatgctatttccccagatacatgtaaaaaagatttgaattcaaatatgcaaatggtattggactatgtcattttgaagcagttaagtttttaaaatccaggctattcctgttttgaaagcagtgccatttaatattgttcttttcttgctattcccactttctatatgaattgagtgggatctcaaatccccttgctaaatggtttagcaatacttaaaattcagcaaagaacattcccaccttcaggagacacctctcctttatcattatggatgactgacatataaacaaatgtgatgcccagaactggagtcagttctgctcttgaaaatattcatacatcaaacaattctccttcttcattttcataaagacagttctgaccatattatcatagctaaaggacaaagtgtatagctctcaaaactcaattgatcttagttatctaagtcttactttaaatgaagataacagaaatcctttctctatgtaaaaaggttaagcttgggaaaaaaaagtgaaagattttctggttcatcctaaataggctttggagaaagaattgctaagtgtgaaactcctcacctactgcatttcattgatcaaagggttttgtaaaacaagcaaatgcagaattttgagaggcatttaaagggcttgtcttttggaagttaataccctttgcttaatttatcattgatttccattctcttttcttctcttataccatcaccgtgtgtaagtgaatataacaagagtctcatttgtctagaataaagcttgaattgtttatgctacagatactcatggggcctgtaaactatgggatgtgtgcgttcattctagtcctgtcagcaccatgggatcctactatgtgccacactctgcttaagtggcctgctgctggctctactcctgcctcaccacagagcaggtgctctcagacacagcagatcccaagaacggatgctttgtacatgttctgttttcatactatctctccggcagcatatgagtagaggcccaggagcctgaaggaaagcacttgtgcccatcacaagcctcgtgggaggagagagagaagtgcttatttcttcacacattttttgattggacatctgatagtcaggcaaagctgaggcctgttctccagttaaaggagaatcacccagtactgctgttcctcctctctcaactgtactggttctaagtatttctctgtatccagcatagaggagacttgatccctccaatggctccaactagaaatgaagcagctttctttgctgttgccatgggctcccttctcccctctcctaaccttcttccctacactctttctctcctccttccaaaccctgggaccagaaaaataatattgttcatatatacaatgttcattttaattacattttctattatacaaaactaactgtcctgctcagaatgcttttcaaccttgtaaaaaaaataaaacaacaattatgtgctaagcaatacattttatattttctcccttaacatccctgtaagggtaggtattagggtcaagcaaattgaggcttggatagattaagtgacttggccaaagtcaaacaatcagtagtagagacactattcagaccaggtatgttcaaatgccaaagcccagctttttacaatgcccccatgctgctgcatatggtcaagatgtgaaaagcaaagcaaaaataagattatagcaccaggaatttgttgaatacaaatttgtttcccttcaagcttaccagaaaattatttcaatatatttcaacaaaaaacaaacactataaaattagttaaagtagcttaaacatttgatttgtattactgtgagtagaacacacagaagtttatgtttaaatgaatactggcaatggagtagaatataatgcaccttaattgatttatagatactgtgccttttaatagctcagttagcaatttccaattttaaccaatcctcttcaataagagcttgctcaaaacacttaacattgttttctttgaatacctacagctagagcaaatgttgcccaccatgataacatgatcagctaagcccgcagtaaatgttttactaccacaacccacatatttgctctggccagtggtttgccctataggtcagattgttcccgtgcacttacccgcagaaactaagttttgtgcttagtactcaagacggttatgttctctaaagtcttcaattctgtagtcacctctccactaatgaaaacttagagatctttgaccctaacttctcttcctatatgtctctgtccaactttgtaaatatacatatacattacctgtgtttacatcaatgaatttattcaactattctgcatgcaaaccaaataactcactgagttttgtttgtttgtttttcaagacaggatagactctagtttagaaaaaaatattttacttgccttatcgtgagaccataatgacaaaaataaggctctctatattatcaatttctctttattttggccagattcaagtgactattcatttccaattgcatattctatttcatttttgcatatctgataccatacaatcatcagtttatttctgtttccataatgaacattatttcttttcttagcccagtaatttccccaacacatgcaatcaataactatcaattgaatctgaattattttaaatatacataactagaaagagatgacatgattatatatttagaaaaccccttcgtctcagctcgaaatctccttaagctgataagcagcttcagcagtctcaggatacaaaatcaatgtgcaaaagtcacaagcattcctatataccagtaacatacagagagccaaatcatgagtgaactcccattcacaattgctacaaagaaaataaaatacctagaaatacaacttacaagggatatgaaggacctcttcaaggagaaaaaccaatgctcaaggaaataagagaggacacaaataaatggaaagacattccatgctcatggataggaagaatcaatatcatgaaaatggccatactgcccaaagtaatttatagattcaatgctatacccattaagctatcattgactttcttcacggaactggagaaaactactgttaatttcatatggaaccaaaaaagagcccacatagccaagacaatccaaagcaaaaagaacaaagctggaggcatcacactgcctgacttcaaactatactacaaggatacaggaaccaaaacaacatagtactagtactaaaacagatatatagaccaatggaacagtacagaggcctcagaaataacaccaaacatctacgaccatcaggtctttgacaaacgtgacaaaaacaagaaatggggaaagaattccctatttaataaatggtgctgggaaaactggctagccatatgcagaaaactgaaactggaccccttcattacaccttatacaaaaattaactcaagatggattaaagacttaaatgtaagacctaaaaccataaaaactctagaagaaaacctaggcaataccattgaggacataggcatgggcaaagacttcatgactaaaacaccaaaagcaatggcaacaaaagccaaaattgacaaatgagatctaattaaagagcttctgcacagcagaagaaactatcatcagagtgaacaggcagcctacagaatgggaaaaaatttttgcaatctactcatctaacaaagggctaatatccagaatctacaaagaacttaaacaaatttacaagaaaacaagcaaccccttcaaaaagtgggcaaaggatatgaacagacacttctcaaaagaagacatttatgcagccaacaaacatatgaaaaaaagctcatcatcactggtcattagagaaatgcaaatcaaaaccacaatgagataccatctcacactagttagaatggcaatcattaaaaagtcaggaaacaacagatgctggaaaagatgtggagaaataggaatgcttttaccctgttggtggtagggtaaattagttcaaccattgtggaagacagtgtggcaattcctcaaggatctagaaccagaaatatcatttgacccagcaattccattactgggtatatacccaaacgattataaatcattctactgtaaacacacatgcacacatgtgtttaatgtggcactattcccaatagcaaagacttggaaccaacccaaatgcccatcaatgataaactggattaagaaaatgtggcacatatacaccatggaatactatgtagccataaaaaggatgagttcatgtcttttgcagggacatggataaagctggaaaccatcattctcagcaaactaacacaagaacagaaaaccaaacaccacatgttctcactcataaatgggagtagaacaatgagaacacatggacacagggtgggggaatatcacataccaggtcctgtcaggcggttggggggtcagaggagggatagcattaggagaaatacctaatttagatgacaggttgatgggtacagcaaaccaccatgacacgaatatacttatgtaacaaacctgcacattctgcacatgtaccccagaacttaaattttaaaaaaaagaaagaggaaacatttgtaccaaatattatagaaaacatagacactatcaattaattggtcagaaagtatttattaagcaattattttgttaaacactgtcccctccattaaaaatatatctagactagtgttctgcaatagcaatctgatacaagtcatgtatgtaactttatatttcctagtagtcacattttaaaaagtttttaaaaaggttaaaagttttcattattatttaaatttttagtataataaagttattttatttgacccaagatacctgaaatatcactttaatatgtaataattatgaaactattattgactggagttcctacaccctctctaccataagggttttttccctaatatatctttatttccttattttctcaaaaaaattcagtaaagttcagtatactcctcctctatgaagccttccctgaccactggcatccccactgaccccacactctgagtcacttggcacactgtggacattagtaattacacataagtaagtgtaattagcttctcattacacttatgcatataaataaataagcagaaaattgagtgattttttttttcttgccagactgtgagctacctaaaggccagtccatgtcttttcatcttcctgtctccagtccctagcacaatgtgtggccataggaagtattcaaaaaatatcattcaaattatataaaaacagaagaaatagcactctctaaaaccaaaagagagccaaaatatatctccataagaatataagaaatgatttatgggtataggaggaggtacagagatttcttttgttgctgttcttttttttgttttgaggcaaagtctggctctatctcccaggctggaatgcagtggcatgatcttggttcactgcaacttctgcctcctgggttcaagccatcctcccacctcagccccacaagtagctgggactacaggcatgtaccaccacacccagttaatttttgtatttttagtagagatggggcctcactatgttgtccaggctggtctagaactcataagttcaagtgatccgcctgcctcagcctcccaaagtgctgggattacagtcatgagccactgcgcctggccagagatttcctcaagttgtttgcaattatttcaccttaaaaggaaaggaaaacaatagtaggcatcagcttgcatgctggaaattttcatacagaataatattatgatgaccttcccatgaaagagagaaagagagaaatatatataaagtgatatatgtataatgatttctatacttagatttagggagtagacatgttttattctaatagcaaaataattaaagatactgttatactggtctttaactggcccagccagaaaactttttatttactaaactcatcttctcaatgaaacaaaacaactgggccaacagaaataatttgctactcaactcgctcctagatgttcagaaaaaaatgagtcaattaaaaacagaattgtatttggaaaggatagtgatggacctgaattgtgattctggtctgctctgatggacaaaagtcatggggcaggaacagcggtagagagggaaggtgaagcacccattgttcaaaaactggggctgctagctttgtaatacaatattgtaatgtcccctttaggcccaaccccaccttctctgatctccccaggacagaaaaagataagaactttgcatctattgttagatttattcatcctgagagatagaatgcctaggccataacataacctatattaggatcatgggtgacagatgggtttctggtagttgttggcactgccttgtttactctgtgtgtgtgtttgtgtgtgtgtgtgtacacctttctccctttatatatcatgtatcaagattattggatttgatcaaatacatggttagaccaggaaagatttgaatacacttataaacttgacttaaacaaattccaaatccatttaacagcaatggaagatgaaattcttccactttttactttgttcatgtcaattcagagacaccactggttattaagacttcctcctatgactcacatcatcaaagctacatattcacacacatttttcaaagggaaaataacccacactttatttctgtaaagttcaatggataacagtaatctgtgcaagaataaatgcctcacaagcttggattatgtgaaaacctcttaaatctacatcccttgagaaaaaaaaaagtacagcactctcagatgcattacatggaccttgcttcttcatttttgactttcattaggaaatcgtctcttccatttgcccccaaatgcaaatgcttcttcaaaaacattttaaaatgttcaatcacataaaacagaaagcagccttcatgattagaaacttacaaggtttcagatgttatttctttaatccaattcatcaaatcttaaataggtccaaaattcatatacagtcctaataagctttgaaaagaatagtcctcgcttcaaacagaacagtactattaatatacaactggttaagtttaaaccagtaagtcataatgaagcaaaagtaggttttgaggaaactgccttaagcctccatgactttacaattccatattgagcactaataataaatcccaattcatatgtgtgactacataaatattcatgcagagttaaatgtgcacctataaatgtacacgatacatatgcagatgtaaatgcattttatgatttcagcttatgaaaatgtcttatctgttggttttggagaaactatcactttgatatccattagatgtaatatatgagtttatcattgtatcaccatcatgttataatgccattgtctgagatttatctattaaacaactcagaagtatgtaaatgctcttaaaatgaaaagaaaattgtgaagctattaaatcatggtcaataaaatatttctatgccagtcattatctaatcatctgactccatcaagtcttaactgcaatgatttccaaacccacttaagtacttttgcctcttcctctgcatccttgttataagaatggtaaattgcttagattagttgactgctgctgtaaggccaagcaacagccaagtttgaaaccaaaccaatgattatgtctataaagttaccctaattaacaaggaagcaatcctaagcattaaatggttaagctttagtattacctgagttctgctatttactcaacttaggaagtcagaaccacggaattaaacatttgtattttgatacagtttcttccataaaaatcatcacaaaattttaggagaaacactcctaaaaagctttttcttattgcataagattaaggaaaccatttgattcaaaggctcaatgctgataagctttagcagataataataaactctctaaagaaattatttgattcatactaatttgcattggtcttataaatggcaggatatggatggttgtgggatggaagtagcctagactagccaacagggaaactgttaagtgtataagggaatgcatatgttaaatagcttgatttagtcaccccacaatgtatacaggcatagctcagagatgtcacaggttctatttcagaccactgcaattaagtgaatattgcaataaagtgagtcatgtgaacttttttatttcctagtgcatataaaagtaatgtttaggctatattgtattccactgagtatgcaacagcactgtatcaaaaaatgtacacacattaactttaaaatattttattgctaaaaatgcaaagaatcatctgaaccttcagaaaagcataatatttttgctggtggagggtcttgccccaatgttgatggctgctgactgatcagggtggtggttgctgataaatggagtggctgtggcaattttgtaaaataaaacaacaataaaacttacttcattgactgactcttcctttcacaagaaatttcttggtagcatgtgatgctgttacagcattttacccacagtaaaagttctttcaaaattggaatcactcctttcagaccctgccactgcttcatcaactaagtttatgtaatattctaaatcctttgttatttcaacaatgttcacagcatcttcaccaggagtagattccacctcaagaaattactttctttgctcatccataagaaataactcttcatccattcaagttttatgagattgaagcaattcagtcacatcatcaaattccacttctaattctagttctcttcttatttccaccacatctgcagttatttcctctactacagtcttgaacccctcaaagccatccctaagggttggcatcaacttcttccaaacttcctgttaatgttgctatttttacctcctcccatgaatcacaaatgttcttactggcatttagaatgatgaattttttccaggagtcttcatttactttgcccggatacatacaggtatcgctatctaggaaacctataaccttaaaaaaatgtatttcctaaataatgagacttgagaggttaagttactccttgatccatgggctgcagaatggatgttgtgttagttgtcataaaaacattaatttccttgtgtatgtccatctgagcccttggaagactaggtgtgttctcaatgagcagtactatcttgaaaggaatcttttttttttctgagcagcaggtcttaagagtgagcacaaaatattcattaaaccatgctataaagacatgtactgtaatccaagttttattctaattatagggcataagcagagtagatttaacatacttcttaagggccctagggttttcaagatggtaaatgagcattggcttccacttaaagtcatcagctgcactagcacctaacaggagggtcagcctgtcctgtgaagccagcattgacttctcctccctagctatcaaagtcctagacaacatcttccaatagaaggctgctttgtctacattgaaaacctcttgtttaacatagccaccttcatcaatgctcttcactaaatctcctagataagttgcttcagcttctacattagcaccttctgctttacctggcatttctggttatggaaacagcttctttcctgaaacctcagattctttttctgcagcttcttcacctctctcccttcctttataaaattgaggagagtcagggccttgctctggattaggttttggcttatgggaatgttgtggctggtttgatcttctatccaaaccacaaaaactttctctatatcagcagtaaggctgttttgctttcttatcattcatgtgttcactggagtagcattttcaattcccttcaagaactttccagttgcattcacaatttggctgtttggcataagaggcttagctttcagtctgtctcagctttcgacctgctttcctcaccaagcttcatcatttctagcttttaattgaaagacagaggtatgaatcttccttccacttgataacatagggaccactgtagggttattaattgacctaattccaatattgttgtgtctcagggcatagggaggtccaaagagagggacagagatgagggaatgcctggtcagtgtagcagtaagaaaatatataacatttttcaatcaagttcactgtctaaacaatcacaatagtaacatcaaagatcaccataacagatataataatagtaaaaataatttgaaatatcgggaaaattaccaaaatgtgacacagagatactaagtgaacacacgctgttggaaaaatgtcaccaatagacttgctcaatgtagggttgccacaaaatttcaatttgtaaaaaaaaaaaaaaaaaaaaaaaaaaacactatctgtaaagtacaataaagtgaggtgagcctgtacatataaacatcatgttgtacatcataaacacacaatttttagagatccaggccagtttatatatacagggactgggtggtaacaatgttaaaaacaaataaccaaagaataggagggaaataataataacaatggtaaaaacatgttgaactctatccttgcattaggctttgctaactgccttaaacatatcctattttatgttcgtcagtgtttcactcattcaaatatattcatatacatctcactgaatataaagtagataaggaaactgaagcccagaaagttactccagatttcacaatcactgaattgttgataggggcttcaattaaaggtcagtcttatgaatgcacttaactattacactacaatggtagccaccttcatcaaggaacttagctgaatcttctaggagggctatgagtccatgaggagaactaatatccatttataagagattagttaaaatggaggttgtcggcaggttttgagtttggacaggtggtttggactcccagtatagagaccaaatagcaacaggagcacaggcagcaataagatccgggtgtataaggcaaaagtccaaagatttattcaaggcagaaagacccaggaggaaatagcttttgggtataaatcaggtaacattttgaaattcaagccacacatcagaaacaggtatcacaaagaaagcatttcaagatctgcaacaaggccttcaatccctttgccgtatttataagacaccaatctgcactaataagtgtgcacaattccgtggaggtagagacagggtctgcaggtcactgtagccgaataacaggtccctaggctgagtagtgctcatgcttctaaaatttccacttccaagttccaaatgctatgctttccccttttccaattaccactatcttcatccccatacatgtctattaggaaaaaacaacaataagacatctacttagttcagtcatctgggaaatgctgtggataatacagtactgtgggtcaaataacacattcaagaaccagtcaatttggtgaaaaaagaaaaatcaaattgcttattttgcatcatgcagagcaaaaaaattactatttgaatgttgtgcttttcaaatagttgtactgatgttgagtagacacaatcatattcaccaggcatctctacactgtcactttggtatattattttttacactgccttttctcttctcggaatcaaatttagttatcctttggggatgcttaattccttaatgtcaatcaccttttttttttaactaagcaagcaggttctttattttttcaactaaattctttaatcagcttttgttcagaaactgtttatttctatctgcattacaaatgctagatttaaccaatctatcaaaccaggataatacaaggaaggatattgtcagttcatcctttcctcttaggaacaaagatgccgtattttgtgctttaaaagaaaagaaataataggattagactaagattgaggacaagaggatgtcaaaccaaagaaaagcatgtggtccttctaaagctctcccaactagtatggggaattgtaatccattcatgctaagtgctttgactatgctcattatgcaaaaaccattagagcctagtatatttagttaccatagttctgcctactgggaactataattaaagcacatttgagcaaatgcaattttatttgttattaagcaactaaaagcttagtcaaccttgcaaatatggcattatcttaagattacaatatgagccagacagctatccaataaactttattaggtcctatctttattagctatgtcttgtattcctattgcaggagcattgtatgctgtacaacagtggtcttaataggtctaatagtttaggatgcaccagaaacacctggaaaagcttgtaaaaacacattactgggccccactctcagagtttctcataccttaggtctgcagtagggccccaaaatttgcatttctaacacatccccagaggatgctgatgctgctggtctgcagaccacactttacaaaccattgctttgctgtataaaatagtggttagagctttggagtgaaacccacctgggctcatgtacttgctcttctactaatacatacatgtccttggacaggttacttcatgtctccaagcctgtatcttaatccatatagtagggataataacatctatccaataggttggttgggataattaaataagattaaaagtatagaaagtgcttagcccaggtcctggcaagagagaaaccaatgaatgtcagtgataagtttattattgttgttaattttaaaaatatgccaagatctaggtcaacatatttataaccaatggtgtgcatcagactcaactgtagggcttttgtaaaattcacacagtgagacaccatccccctcagagatgttgatgcaatcaatatttcattgattctaagatgccattgatcataagatacaccattattttatgtatcactaagaaagataaggcagaaattaacccatgattattctcagtgaaataaatgaaacatagaaaaatactgcataatctctcttatatgtggagtctaaataaaaaacgtcaactatacagagagagtagcagttaactaggatgcacaggtccagaaatataatgaacaacatgaggattatgtaggttgagtatccctaatccaaagatctaaaatccaaaatgctccaaaatctggaactttctgagcacagacatgatgctacacaggtacctgagatagtggcaacactgccttctgatcattcaacatacacaaactttgtttcatgaacaaaattatttaagatattgaataaaaattacttttaggctatatgtatacggtgtaataaaacataaattttgtgtttaggcttggatcccatcccccagatatctcactatgtatgtgtaaatattccaaaatacagaaaaaggcccaaatctgaaacacttctggcctcaagtattttggataaaagatacacaacctgtagttaataaaattgtattgtattgggcatttgcgttaaataagtagatttagttgcctgcttttgtcatcaaaaaagtaactccatgagatgatagatatgttagtttgcttcactatagtaaacaccttactgtctacatgtatcccataacatcacgttgtaagcctcacatatgcacaataaaatttatcttaaaaaagtttgatcaaactaatgtaaagcacatccagatttcaaaaatgagaaaatatggggaaaaaagtacatactggaactgatgaaataaggtagctggagatataagtgtgggcttgcttcccaggttattgtgatgtgcaattctgattaaaaaccactaacttggctggccacagtggctcacacctataattaatcccagcactttgggaggctagatgggcagatcacgaggtcaggagattgagaccatcctggctaacacggtgaaatcctgtctctactaaaaatattttaaaaaattggccagtcatggtggcaggcacctgtagtcccagcttctcaggaggctgaggcaggagaatgtcgtgaactcgggaggcggagcttgcagtgagccaaaatcgcgccactgcgctccagcctgggtgacagagcgagactcttgtctcaaaaaaaaaaaaaaaaaaaaaaaaaaaaaaaaccactaacttagtcaatgtgacagctgcaagtgggactcaaagttcagatgcctcaaagctgagagggctcataggttggaatccccattcttagaacaagaatataacccaatatcataatcaaccacctaattccatagactgtttatgaaacaaaaaatatttcctcttggtgtaagagcacccaccctctaaacttagaagaagacttctcccactgaatagcacttacccacatgaactggtcatgttcatgaccagaacacatcagtcaatcagatcaaaggagagtatagcacagttagaaggaaggtgtcaagctgttagaccaagataggtttttcttcttaaacatgaattccaatcttgagatttgaggattatttagggagacaaaacatgatttacatttcagggagaagggaggatgatgaaggtcacatatgttaccaggacgtggccctagtaggcttctattttccgtcttgagttttaaattgcagtttgtaatttgtttcaaaacaaagaaagtagattttgtataatctgtttgtcttatcaagtttatggccactcccatttgccttcactctgggaatcttggatgaaggtggggaaggcatgcgcctaccctcaactttatgctaacactcctgcccataggaaatgcattaattctgtaagccatcacagaacaggacaagatcttatgacagttttatttgggagctcagaatttctaataacttcaataattatctccggtagtctccatgcacatgagttaattataacaagaaaataaaatacttatttcagcttctaaaaattctaagaatgtaaatctctaatgaagtgttgagataatacatagctgtttttacaaactttcaactaagaaaatttcattttaactcctgcctacctcatgaccacccagtcctctctttattattacttatgttaatattaatttaattattattaattttctaaccagggctcaacccagatggacaaacaaacatgaaatcagggactgccaaggacatttcttcaaggtccaaatagttacaaattgtagtgataatgaagttgaaaaacacatggatatggatgactttctcattttctcactatactggaaacacacacataaactatcaatgaaatctatacttcaaaaaatatattttcaaaccttagatacctcttctggtcctggtccatattgaattcctttctaaaatcagaaattaaagctttatcataatactctttttaaaactacgatgttcttaaatttttatgcttccaattggagaatggaacatacaaagtattggccgggcgcagtggctcacgcctataatcccagcactttgggaggccgaagggggcggatcacaagatcaggatattaagatcatcctggctaatatggtgaaacccgtctctactaaaaatacaaaaaattagctgagcatggtggtgggcatctgtggtcccagctactcgggaggctgaggcaggacaatcgcttgaacctaggaggcggagcttgcagtgaaccgagatggcgccactgcactccagcctgggcaacagagcgagactctgtctcaaaacaacaacaacaacaaaaaaaacgaaaatacaaagtatcatgaaatttaacaaaaaatggtcttatgtttccaaaaggataacactgattttattaaaatgtctacataatttaaatgactgcacatgtggaataaaatttaatataaaactcagtcacctgaataatgacaacttagaaacagtcacactggtcatagagagtatctgtcgacttgaaggagaaggaagcagccatgtctttataggaaactagttcctgttttactatagagatgacagggggttggggttttattttcattatttttttttttttacagattttaccttgatttagttgcataatgaatgcaacacctattttccacataagaagataaagactgatttgaaatttttcaattctgtccatcactgttgtatccaactgacttattagcatacaccttgctgcaagggttttatttttactgagggattcttcgtgtgcctcctcattttcaccaaaatgtatataaatctcctgaattttcatgacactgatgtggctaaaaattttaaatattttcagttctttgaaaatacaagaaaaaccttcagaaataagaattagccatggttcagaggttctgatttgttttaacaaaaacatcaattatttcaagttctctgctgactagaaaatagtggatttcatttgatatggcaaagcaacttgttatgttttgtgctaccataaaatgcatcacaatttatagtaattacctgaatattcagtttgtttctggtaccctcctctcagtcctacgtgtctgttagagaatcaaagggtactgcttgtctaagaaatatgctaaagagaggacaacacaatatctggagaaggaaataagaatcatcaaatgccctttccttctttgatataattcctaagattacagaaattgaagataacctagcacacatcacctccaaagagaacagaagaaggtcttttaacttaatcttgtagataaaatggattacaggagctgagtgcccagactgtgaggcagatcagtaacagtttcaacagctatattcaaacggtgttaactagtgcatcagcatcaacctagttctaaatctcagaatcatagaattcttttctgggttccatttgtttcaccatgttactcaatgtcctggaagaaaatagagcggacatcataaaatttgtagaagggagagtggccatgtggatgactgaatggggttggaagctgacaggttggagacaaggactatatcttaaattaataaaaataaattttaaagtacttatagaaatgaagtatccacaaatgaaaagtaataatagaaataaattgaaaagaaatagaagtaaatgtaaaatgatgtgattaagtccaaaaggacaattgttttgtacagaatggagatgtggcatagtagcaatacaggcaactaagacttagagattttagtctacagaaaggttaatgtgaatcaacagtaaatggaatatttttgagtgaatgaataaatgtaatgtattataggaggggagaggagggaaggagaaaaagagtagggaagcggaggggaggaaaagacaggagaggagaggaaggagaggaaaaggagaagagaatctgtataaaaggaagcaaaagccccacttatctctatatagcctggacaacccatgaagtactgcaatacaagcatggagaaactgagcacattcaagcatgacctgagatgtacaaacaatcaaatcaataatatccaagaattcctcgaagtacttgagcatatttaccctggagatctgatcagcatgctcaaatatcctaataacttcactgggaaaaagaattagaggtgttgtgtttgaccccagtggttacaagtaggacagatgtattagactctctaagggtaccttggtgtcaaagtcctctaaggacagaatggctcagcttgggagctactgatcactctctctcctgaagatgctgaaaccctgattggatgacccttggtaagacttttgcaaaaccaagtcaagtgttagataggtggcaggattagatgatctttgaaagtccctccaaaccttaagattccaatatgtaaacattttcctgtggtgcacattaaatccttacaaaagactttctctcataaagacaatgaaaacaaatggttagcctaagggaggtgaaccaatcttcagaaaaccctaagagactcccctattttcttgcttgtttgctcgttagagaactaatctcctataaaacaggaatttattaatatttctttgtcctctgctatactggccgactttgggaatttgcacacagcacactttatcttgctaaatataatagtctgtctggcattcttcctttgtgagaaatccttattcacttgcataaattatgtgtaaagatctgaagcatactttcctttcttcaatacagactattcccagaagtagcctgacacatgccaaacatctgctcccacatgcagctcaatacatgatattgatatgtattatcactgggtgaattctaaatacaaagccaatttagcacactcctgaacaattccctccttctctcccggccaagctgcagggagctcaaggaaatcagaataattctaatacttgcctaagcaagctataaccaggtaaatctgctaaaacaaaaaccacagtataacatttcaaaatctaataaaaattagatacacatgataaatataaatgttcatctaatttaatacatagctaaatacatagaagtattttttagtatctgctatacttacagtattgaaagacgttgctttcctcaactgtgaattcctgggtgtcttgagtgtttgttaagcatttatatgagcctagtccgtcttttaatgatcgaatgcaattatcgttcatgtggtacaaagaaaggtgaccagaatccctaaatcttgaagtttttctagtcatctatgaaagcctctagttctctaacaggtattttcacaaagaccttcagagtaaactcatttttactgctaactagggctttggacccaaacacctctctgctctctttccctggtgaagtaacctggatctcacataagcttggcagacagctcctatcccttgggctaaggattaataaaaccagccccagcagtgaatccgttatttccttcccaagtcccacactgcttctggcccctggcaaagccactgccctggcacaggttacatctgcccagaagaggcaggtttcctaactggtgaagtcattatacacatctgcattgcccaatacagtagccacaagctgcatgtggcaattagttcctcagatgtacaagccacatttcaactgctccatagccatatgtggctagtatacagaatattttcatcatgcgctactggacagtgtgccctaggattccattttgttctcaatttgggcaaacattgttcttggacttgggcagactttatctcccacttaaggtcagagtatgcaagggtttattcatttattcattcaacaaatatttatcaatcccttgtctaactactgaacatataaccacaaataaaacagacatggcacctactctcatggagcttacattctggtcagaaaaaaattaacgataaacaagtcaacacctaatggaaatgattctttcagctatgaatttcagtattagtttgtatcatttttagcttcatggtaacaagatattttggtttcattcaagtggatccatccccacagcagctggcctgctttctcttgattttcttcagatgacagtaactaatggttttaatatttacttgaatctagagtttcttcacctttgtttctttagaacttttactcaaagcttaattcttgcctctgtccttgattctgtcttgaaaggttctccaaactttaacttttcaatcatcagttttaaatgtaactcttaactatttatattctcaaatagtacaacaaactactaggcattcgcccttggaagataccacctcctcagctccttaaccttggcgatagttcttcagaatttctcttgaactattacctttctttcattcccagtgggccatactaactaagctgtcatttctcatacatgaatctctaaaacaacctccccaaaaggtttattgtctcaattttgtttccttacaattggtcatgcacactaaatcacaactactttaaaaactacttttaaaagtgccagtcattgcctctctcaaccttctctgcactagggaagctcccttgccccagtctttcacccctgaaaatgtacacctgtgccaagtgtgttcccacctttctctgtttgagagcacctgtcaggtgctaagcccaccactctctgcagtagttctcaagcaaccagagacactaacagatgagagcttcagcagtttggcagccccacatcccccgacctcacttaaccctagtcacagcttccaaaccagcaccacttcaagggatattggcatagcagccaagttcattggggctaggacttccaaagtcaggacagctggctctggggctaaaattgcagctgtgtttgggagcctcaccattgattatgccaagaaccctgtctgaagcaacaagtcttctcctatgccattctggggctttgcactctatatatgtcagttttttgctgcttagaacatctgaaaatgggtaatttatttttaaataatttatttcttacagtttaaggagaacttgagtccaaagttaagagaccatatctggtggacactctctacagtcctaaggtagtgcatggtatcacatagcgaggaagttgagcatgctaaagtgctagctcaagtcactcttcctcttcttataatgccaccagttaatccattaactcattaatccatggatagactaatctattcctatggacagatctctcatgagccaatcacctcttaaagtccctacttctcaataccgacacactgggtattaagtttcaactttggagggaaaaaatatttaaaccatagcaccctcttagaggccatggagttctttggcctaagggtggcttttctcatcctcttcaccatgtaaagaagctgtccccaccattaatagttctttcctccatgtctcatctatcttgtatgttcttttccctatacctttctcaggcaatctgagaaaagtggttggctcaaggtttgacagagggaagacaaataaatactgcatcttattagtcggggttctctagagtgacaaaactaataggataaatacatctatatctatatctatatctatatctatctatttatctatctagggagtttattaagtagtattaactcacatgatcacaaggtcccacaataggctgtctgcaagctgaggagcaaggaagccagtctgagtcccaaagctgaagaatttgcagtccgacgttcaagggcagggagcatccagtaaaggagaaagatgtaggctgggaggctaagccagtctaaccttttcatgcttttctgcccactttatattctggccatgctggcagctgattagatggtgcctatccagattagggtgggtctgcctttcccagcccactgactcaaatgttaatctcctttggcaacaccctcacagacacacccaggatcaatactttgagtccttcaatccaatcaagttgacactcagtattaactatcacaagtccaccccttgacaacttgaacctatacacgtctcctgagatcatacataatcttcaaataaagacaataatgaggtcataattacacctaatataatacaactatcctttatacaactagaaacgcaccaatccccaacccaaatgctattccatagagttaacaatacttaaatactgacatggatatgaggtcaataaatcttatgtcacatgataaaggaaaaaggaaatgaagatattttcttagtacaagtgtgtacatgcacaaacatgtttttaacaaagaaggaagaaatatgacaattacagtcctcatttctgcaactggtcacgtggtcatagctggtattgatgactaccttcttctactacccattctgtattccctttgcctttagcaagcacctcagcaggtcatggtttttttcctggagtgacccaaaccttcattcctgaagggtctgagccatctgcagtcctgcctggattgggctgctgtagtttcccattgaccttaatcacagggcatggtaatactaagagatgccctaatgaatctcctatattccctgcatacccttccttacctctgttgtgtagtagtagactgatttcgtcttgatagtctgggtcaatcaccccagacagcactgtaacccccttcttagcctgttgacttaaaggtaggaggagcccaaagtgtccaggtggcaatcttaacttccagttcaaaggaatcattgttgtgtctcctggtgttcctccctctggaactaagacttctaggccagcagaacataatattgtgggaacaggaagcaaaattttgctagtgggtcactaggagtaatggtgagtggtgccatcaaaaggccatcctgaagcatctggattgaaaggataatagaattgcctttggaagtcagaattaaaatgccaactaagtgacaatactttgcagggctggggcaaagttctccagaaggctgtgtatgctctgagccagcttccaatatacggtactgcttttcccatagccaggatatgcagagtccaggaatcaggggtggaagtggaagtggcacctcttattatcacccctagtgacccactagcaaaatttttgctacctggacacttggggttcctcctacctttaagtcaacaggctaagaagggagttacaatgttggctggggtgactgacccagactatcaagatgaaaccagtctactactccacaacggaggtaaggaagggtatgcgtggaatacaggagatccattagggcatctcttagtattaccatgccctctgattaaggttaatgggaaactacaatagcccaatccaggcaggactacaaatgacccagacacttcaggaataaaggtttgggtcactccaccaggaaaaaaacccacggcctgctaaggtgcttgctaaaggcaaagggaatacagaatgggtaggagaagagtgtagtcatcaataccagctatgaccacgtgaccaactgcagaaacaaggactgtaattgtcatgagtatttcctcctccttttgctaaaaacatgtttgttcaggtatacagaaaatatcttcatttgtaccaagaaaatatcttcattttatttcctttttcctttatcatgtgacataagatttattgacttcatatccatatcagtatttaagtattgttaactctatggaatagcatttggcttggggattggtgtgtttccagttgcatgaaggatagttgtattatgttaggcataattatgaccttattattgtctttatttgaagattacatatgatctcaggatgtgtatgggttcaagttggcaagggtggacttgtgatggttaatattgagtgtcaacttgatgggattgaaggactcaaagtatggatcctgggtgtgtctgtgaggatgttgccaaaggagattaacatttgaatcagtgggctgggaaaggcagacccaccctcaatcaggggttcacctaattagctgccagcacagtcagaatataaagtgggcagaaaaatgtgaaaagctagactggcctagcctcccagcctatatctttctcccgtgctagatgcttcctgcccttgaacaccagactccaaattcttcagctttgggactcggactggcttccttgctcctcagcttgcagacagcctattgtgggaccttgtgatcatgtgagttaatactacttaataaactcccctttatatatagatataaatatgtcctattagttctgtcactctagagaaccctgcctaatatagattttgtcattaccctactcagtaatacattatgactccctattatctatggaatcaagtttcttttttatgaagttattgccttgaaaagataaccctaaaattgaataattctgttatttttaccattttacttaggagtaagaattataacctgtttggttctgaaaatgattttagacctttcaggcggatgcaccttttggttcatgtgatatatacctgcatatgcctcattttatgtaattaaaagtttcctgataattatactcccagtttccaataaattcttccaccacacacacacacaacacacacacacatgcatgaagtagaagaaaagcttttagagatcatttactgagcttattgacacaaatgagagttttaagaagcacaagcaaacaattttagcatattttggccaactttatatatattaatatttcccatttccttgtcacgtgcatgaagcccacatcatgtctttttccacagggtataaggccctatgctcaatagcttgaattagtcacagaatgtctttctgttggcaacttttggattaacatccacaaattaaaatcagctcaacctcaaactaaagtatctggttatcattaataacttcgccactggacagaatgataaaaaataaaaagagaaaactcattaatttattatgatctcaaactaaatgtttttctcttatgtattttaaagatctgagaagcaaaattacaatttgagtttattagtaactatctgagtccactttctgttgcttataacagaatacctgaaactggttaatttatatggaaaataatttatttcttacagttatggaggccgagaagtctccaaagtcaagggaccatgtctggtgagagccatcttgctggcagggattctctgtggggtctcaaggcagtgcagggcagggcatcacatggggaggaaactgagcatgcttactcaggtctctcttcctcttctgataaaaccaccagtcacttctgatgacaacccatttatctattaagccatgaatacattaatcagttaataaaggcaggttcctcactatccaatcacatcttaaaggccccacctctcaatagtgacatactggggattaagtttcaacataagttttggaggggacatttaaatcatagcagtaactgaagcagaactactaaaagattgttaaaatattctaatcaccttttcaaaaatatataattcctttttcatgagggttaaatgtataaaaattcaaaaattcaagtcatttttttttttagacagggtcttgttctattgtcccagctggagtccagtggtacaatcatcagtctctgcagcctccacacttcctgggctcaagtgatccttccacctcaacttcctgagtagctgggactaaaagcatgtgccaccacccctgactaatttttttaaaacattttttgtagagacagggtctttcaaccctggtctcaaacttctaagctcaaatgatcctcctgcctctgcctcccaaagtgctgggattacaggcttgagtcaccacacacaggctgtaatcccaagtcacttttattatcataacctgctttagtaatcaagagaaagaaaattctttttatccttatgtcatattttattatggttgaattaattcttatagttagagtacatcctaaatacaactaaagaagttaactgatgcttaaagttactaaagcccaaattatttttacttttcttttcttcataataatgtctgtttctgttatcataaatgtagtggtctctgagaagctatgcacttttatatttgttactcagacctcttgaaaaatgttcaaaattattaatatacacaaatgtatagaaaatatccatatacattaatatacagaaataatttcctctcagtagaggagactagatcatagtgaatcaatgtttaacccatttcccaacaccatttaacatgagcttcaggccactagaattacctccattgacttagaaaagtacagaagacataagtcatatcaaagacaacaggaaaatgtttaattgtgtttaagtgcttctatatttgtatgacaatatttatttaacaaacattgatatagcacttgctacatcaggcaatgtttcaagcttttttaataaatattaattcatctaatcctcataacaaccttatgagttaggtaatatcatccctatttttcaaatgggaaaactgcgcgtaaaagaagtatcttgcctaaatccctagaatcaataaatggcaaagtcagaatttgaacctatgagtctggctccagagtctgagctttcaagcactactccatcaggctacctctcaatattctaaatcatttccatatttggaatctgatttaatataaaggtgttatagcttttagtcgtgtaaaaaacttttctttttgagatctgaaagtgacttcagatctcaaacacctaaggagacgtgctggtagagatctgaaagtgatttcactatgtggctgctcccacacaaacacccaatgtctccttgactctcatcccactagctcatgtacctcctgctcggcatccaccaaactctgttttctcctatagcaacacctaccacaatatttgtatattaagtgttacgttctttaaggacaagaagcatatcttgttcacagtttttttttttgttttttgtttgtttgttttttgagacagagtctcgctctctcgtccaggctggagtgcagtggtgcaatctcggcttactgcaagctccgcctcccaggttcacgccattctcctgcctcagcctcccgagtacctgggagtataggtgcctgccaccacgcccggctaattttttgtattttttttagtagagatggggtttcaccatgttagccaggatggtctcgatctcctgacctcgtgattcgcccgcctcggcctcccaaagtgctgggattacaggcgtgagccacggcgcccggccttcttgtttacagttttatctccaacacatgtacctgagcagacaaagcatgattataaattactcaacagccagagagttaaactaacttcttatcaaattacaacacctaaaataaataggtttcttctctatacctatgggagtaggtactcattccaattttaaaattagcatgtgtgtggaaataatcttgtgatttaaagaaaatgacactgcagaaaactacattaatgaatggtcctctccatcttggcacagagatttaaaatttgggtgtttcaaaattaaagacactaaagctcttcgtttaaaaaaaaaaaatgacaacacagatgcactgagcttttcaaactaaaagtcaggaatatatatcaagctactatcacaaaacacttccatcaaaaccctgcaggaagcaaacaattgccagctagcacatcacccttcatgcgaaatgacgtgcgtcattttgtgcaaaggacatcaaaagaacttgtcagttaaacagaggatttagatataccatgagaaaactttcatgcaccactttacatatttccagcaaaattgctatagaagcacttaaggcacaataatttgaacctaacttgacttaagtaaccaacacaaactacttttctaaaatgtctcctattttcataagtgatagaatttagttataaaagtcctactaactcttgtaaaataatctacagagacatggtgattcatttgctttcattcagcagcatttgcttgtaaaattattaattatgtgcctattatgtgctaggtactctattgggtgttcttgtacaaatcatttttctgccagcaaagccatatttttttgagttagtaattcccagatttttgtcaaattcaacagcattatgcaatgagttcttagtatgtacagtaaggaagagcagaattttagttgatgtaagtaattctacattttattttggataacaggaacatacaaactatatacatgcaacctgaatattcttattaactgttcattttgcatttctgtccaatttgaccagtgaattcactcaaatagtcaagttggctttggcatttaggtaggaccagtaggtccataaagtgagagagtcaaatgggtaatggaagacaaactccctcctagatcacaagctcctgagaataagaactgtgacttctatagtactggggccaaatgtatttcctggcacagactatgcattaatatatgattgtttgaatgaaagaatgacctcactaaacttctcccaaacatataaaactatatcccatctgtaaaaatttccagagggaccagacatgatgatggtcatttggtcattatccttattaatattaaccttcctaagtacagagatcccatagaggctcttagggtacaataaatcaaacctaagtacattaattaaccaatacaagttataactttactaacagttattattttccgttaaatttcctaaattctcttaatcttttatcactgaatctgtttttttaaacttttttcttatcttttaaattattctgattattaagttaaaggttaacaagataataaatcataactctgcttcaaagcttgccagcttaaattctattaacaatgcctgattattcaagcttatctcctttttataactttgaaaataagctgaaatctgcacctctaatcacagtgtcctgtaccctttcaactatacgtttgccttgccttccactaaatcctaaactagagcaggggtcaggttcttgttcctctttcttgccatcctctcaccctgacacgcactactgtatccacttcaagggcatgttcaggaaagataatatagcactgcaaaaatgggctactgggggctgggcacggtggctcatgcctatgatcccagcactttgggaggccaaggcaggcagattgcttgaacccagatgtttgagaccagcctgggcaacatggcaaaaccccatctttacaaaatgtacagaaaataaataaaaataaaaataaatagccaggcatggtggtgcgtgcctgtggtcccagctactccagagactgaggtgggaggatcacctgagcccaggaggtagaggttgcagtgagccactgcactccagcctgggtgacagagcaagaccctgactcaaaaaaaaaatgggggataggaaggcagagaaaagcaccccgaagccctcgggcggaaaattggattaaaaccttaaagagaagtaaaatattctcctttactgtctccatttcagtcattgcctttaaaattcatacatatattccactagtgctaacctaagagaatcagcattatttaatatccattgcctcagacactgttgtttggccaaccatactcattcccaggccccagccaccttcttctgtggctaggaacactaaatacttatttttcctgcttctcttgcagctaagcattgccctggacacagttctggctgatgagatacaagcaaaacccaccagagggttccctgaaaagattttgctttcatgattaaaaaaaaaaaaaggagaaatatggctggcattgtcacttctcccttcatcatgtcctgaacatacaatacctaggcttgcattatgtattttgcaaccgtgaaataaaaagcatgaaaatgaaaaacaaactcaatgggaatggtggaacagaggattaaacaggattattaagcaactaaacctatgcaaacaatcccctgttttcagatagcttgatgtgggaataaaagattgttgacgttaccgttacttacagacaaatgctttccaatggagatgctacttaagacagccatggtttaaatcctggttctgccttttactgtgtgaccttgggcaacttaataaacttttccaagcctccatttctcatctgtaaatgggcataagtgaaattgctacaatagcattgttgtgaaaaatataaaataatgcatttcaagtacttggcattgaatttggcacaaagcatttctctcaaacattaaaagcacattttaatactaaacacaatagaaatgttttaaaaataaatgttgcttttttctccaaataattacatataaaaattaaacatttagggtgttagagaagtcaattctttatttttaaaatcatcattatatatagtttaacttaagacaatttacaataagaattaaaatgtataatgtaaatgtaaaatgtacatttgtgtaattaggtagtacaaatattaactaataattgctatgtggattaaattttttatattattctaattattgtgatacaaaataagccatttcctccagcacaagatagactgaaatgactggcagtaacctcacaacttcttgttgccataccacccagaaacctgagacatgtgaatctttactgttccacttactaggttattttcaggacattcaatcatttctctttaatcattgaaggaaacagcaaatctctgtttgttgtttcgctttgttttagtcagaagcatttttgcttcacttcaacaagatcatcactccaattgtttctctttagcagcttatcttacaaggccagtaaaagactgtgttccgaagcctagagactttccatttatagctttccattaagcctcttaaaagtaggtatttacacaaattaattacttaaaaggtagggccttttatgaaatagcttttttattaattcaaagagattataatttttaatctaaacctttttaaaaaggatttgagtcgacttacaacaaaagacataaatagattaagattgttaaaataaaccaaaacatatgcaaatactgggaaaaaaggatgcaaataaaaaaatcatgatggccacaattatgcaaaacatttaactgtgaacttctactaaagcaaaaatggaaacagagttgatttttaaaatctcattatgttagagggaaagtgtatggtctatatttttatatgctgatactcagtgtagccttagtactaaaatttcagtaggaatttctctcatggcccttccccaagaaaaattaagttccataatacacagtgttttcatcagtgaggttcagtggctgctttgaactttaataaaagtcaatagcatgacattataccagtaattttaaaatgattttaagctatggaatctgaaaaaaatatgcagcagctaaatatataaaattatagataaataagaacttctctaattgaaacagagttaaagtgcctaaagctactataaccagtgattacagaatctgagtaaggaaaaaaactgtagccaataaactgatcacagtgccttgcttagttacaaatatacaaatgcaaatacaatgtcctaagctcttatgctctcctgacaaggttggggatgaggcaagaatgtctactctcattgctcttattgaacattatactgcaagtcccagttcaataaagcaaaaagaaaaaatgacacataaggaagacaggaagaaataaaactgtctttattcagaaagagtgtattgtgcatgtagaaaatcttaaaaatctacaaaaagccactaaatctaataagttaattgagcaagattgcaggatacaagttcaatagaaaacaaccatttgtatttctatatattaacaataggcaattggaaataaaacaaaatatattcacaacagcatcaaaaatcatgtaaaactaaggattaaatctaacaacaggtgggcacaggcagttcattaaaaattacaaattattaccaagaaaaattaaagaaaaattaaataaggatatttctatggagtgaattttgtccccttctctacttcagtttatatgttgaaaccctcaatgtgacagtattataaatgggtactttgataggtaattaggtttacatgaggccatgaggatgggccctcataattaattagtgtctttataagaagaaacaccagagagcgtgccatctctctctccgtgtgtgtgtgtgtgtgtgtgtatgtgtgtgtgtgtgtgtgtgtgtgtacacaaagaggtcatgtgagcacacagtgagatggtggccacctgcaagctaagagaagggacttcaaaataaaacttaccttcccagcacctttatcttggacttcccaacatccgtaactatgagaaaataaatttctattatttcagctacccagtctatgatattttgttatggcatcccaagctgactaagacagagatatacagtgctcatggatcagacgacttgaggttaaaatttaagatacgaattcactgcagatttttctataaactcagtataatcagaaataaaatcccactaggcctatatgacccaagaattccatttgtaggcatatacataataaaaaacagggactcatacagatatttttatcattgctggataattcacaataggcaaaagttaaaaacaacccaagagtcaatcaacaggtaaatggataaacaaaatgtggtatatacatacaatagaatgtcattcagccatgaaaaggaatggagttctgacatatgctacgacatagatgaatcttgaaaatattatgctgagggtggagcaagatggccaaataaaagtctccacaaattgtctcacctaaaaggaacaccacattttaacaactgactacacacaataaaagcaccttcataaaaaacaaaaatcaggtaagcaatcacagtacctggtttatattgctgacagaggaactaaatgggtaggaaagacaggcttaaatcactgagaccacccctctcacattccccagaaataattacatggcatagaaagagaatctgtacacttgggggagggagagcacagtgactgggggactttgcattgaactgagttttgccctgtcacagtggaaagcaaaagcgtgatgaactcagccagtgcccacacatgaagggagcatttggaccagacctaaccagagaggaagtgcccatctcaatggtctgaacctgagtttctctgcaagtcttgctactgcaggctaaactgctctgggatcctaggtgaacttgaaaggcagtcgaggacacaaggactgcaattcttagggaagtcctgatgctgtgctggacttagagccagtggattggggtggcacatggcctagaaagacaccagatgggccagctaggggagtgcttgtgcaactcctcccacaaccacaggcaggaaagcttgcagcaataaaaggactccttccttctacttgaggagaggagacagaagagcaaagagactttgtcttgcaccttggatgccagctaaaccaacatagggtagatcagtgggcagagtagtgaggcctgcatcctaggccctacctcccagatgacatttctagacacactctcggccagaagagaaacatcttccttgaagggaatgaacaagtactggcagaattcatcaccttctgactaaagagcccccgaaccctgaatcaccaacagcaatactcaggtggtataccactggccttgggtaagactctgagacatgctggcttcagctaccagctcagccatagtagcgcagagcaccaagtgggctcttagggatccctgaatccaggaataggctattggatggcacttatagacctgccctaggccaaaggggagcccacttccctgaagagtgagccccaggcctggcagcattgaccacaatctgactgaagagcccctgggccttaagtgaatcttagtggtggcctggaaaaactccctatgggctagtggtggtggtggcaacagggaaaggcttctctgcctgtggaaaggggaaagaagaatggaaagagctttgtcttatggtctgagtaccagcttagccacaatgcaacagaacaccaggtagatttctaagttttttttttaattctaatccctggctcccagacagcatctctagacctgcatgggttctggggaaactgactgccctgaaggaaatgacaaaatctgtggcttccccacctactgattgtagatccctagaatcttgagagaatataggtcgtagtcaggtagcaaatatagtggaccttgtgtgagactcagtactgtgctggcttcaggtctgacctgggatagtcccagtggtggtggccacaggggtgcttgaatcatgccatccccagctccaggtggttcagcacagcaagaaagacttcatttgtttaaaagaaagtagcagaagataacgagaatttcttcctggtaatccagggaattcttccagaccttatctaagaccacctaggtggtatctttatgagtctgtattactcggcttggaacccaagtctcttttgaatatctagaaagccttcccaagaagaatgagcatagagcatagacaagctcagactgagaagactacaataaatacccaactctttaatgcccagacacagacaaacatccagaagtatcaagaccatctaggaaaacatgacctcaccatacaaactaaataagggaccagggaccaatcctggagaaacagagatatgtggcctttcaggcagagaattcaaaatagctctttcgaggaaactcaaagaaattcaacataacacaaagaagaattcagaattctatcagatacatttaacaaagagattgaaataattaaaaagaatcaagcagaaattctatagttgaaaatgcaactgatgtattgaagaatgtcttagagtctcttaataacataactgctcaacaaaaagaaagaattaatgagcttgaagacaggctccttggtaatatactgtcaaaggagacaaaataaaaaggaataaaaaataataaagtaagcctacagaatctagaaaatagcttcaaaagggcaaatctaagagttcttggccttaaagaggaagtagagaaagagatgagggtagcaagtttattcaatgggataatataaaagaacttccaaacttagagaaatatataaatattcaagtacaagaaggttatagaacaccaagcagattttacccaaagaagactacctaaaggcatttaataatcaaattcaaagataaagaatcctaaaagcagcaagagaaaaaaaacacacacacaatagaactttaatgcatctgtaagcagacttttcagtagaaaccttactggccagaagagagtggcatgacatacttaaagtacagaaggataaaaacgttttaccctggaatagtatattctgtgaaaatatccttcaagcatgaaggagaaataaagactttcctagacaaacaaaagctgaaggatttcatcaataccagacctgccctaaaagaaaggttaatgggagttcttcaatctgaaagagaaggacaataagcaataagaaatcatctgaaggtacaaaaatcagatagtagaaagcagaccgaaaaacacagaatactataacactgtaattgtggtgtgtaaactatgtttatcttaagtcaaaagactaaatgatgaaccagtcaaaaataacaacaactttttaagacacaaacagtacaacaagacaaagaaaaacaacagaaagtccttacttgtcaataacaacataaaatgtaaatgaactaaactctgtaatcaaaaagcatagaatggctgaatgaatttttaaaaaaagacccaatgatctgctgcttataaaaaacatacttcaactataaagatacacatagactaaaaacaaataaatggaatatttcatggcaatgtaaaccaaaaaagaacaggagtagctacagttatatctcataaaataaatttaaagacaaaaactataagaagagacaacattgttatacaatggcaaatgggtcaattcagcaagaggatataacaattgtaaatagatatgtacccaacacttgaacacccagatatataaagtaaatattattagagctaaggagagagacagacctcagtacaatagtagctggagatttcaacatcccactttcaacattgttgattttctgcctgggaaatctgtccaaagaaacatcagacttaatccagactatagaacaaacgcatctaatagatatttacagaatgtttcatccaatggctacagaataaaaattcttcaactcagcatcattctcacagacagaccatatgtcaggctacaaaacaagtcttaaaacattcaaaaacaattgaaattgaaataatataaaacatattctctgaccacaatgaaattaaactacccatcagtaacaacaggaattttgtacactaaaaaaaaaaacatgaaaattgaatcatatgctcctgaatgaccagtgggtcaatgaagaaataaagaaggaaactgaaaaatttcttgaaataaatgataatggaaacacaacataccacaactcataagatacagcaaaagcagtactaagaggaaaatatatagctttaagtgcctatatcaaaaaaagaaaaacttaaacagcctgatgatgcatcttaaaaaattagaaaagctagaacaaaccaaaccccaaattattagaagaaaaaaataaacatcagagcagaaataaatgaaattgaaatgaagaaaacataaaagataaacaaaaccagaagtttgttttttttaaagataagcaaaattggcaaacctttagccagactaagaaaaaaaaaaaaagagacgatccaaacaaataaaatcagagagaaaaaagaagacattacaactgatacaacaggaatttaaaggatcattagtgactactatgagcaattatatgctaataaattggaatatgtggaggaaacggataaattcctaggctcaaacaacctacccagattgaaccatgaagaaacccaaaaatggaacagaccaataacaaagtaacaagattgaagctgtaatgaaaagcctgccagtaaagaaaagcctgggaaccaatggcttcagtgctgaattccaccagacatgtaaagaactaataccaatcttactcaaactatttcaaaaatggaggaataaatacttccgaattcattctataaatccagtattatcctgataccaaaatcagacaaagacacatcaaaaaagaaaactataggccaatatccccgacgaatgttgatagaaaaatcctcacaaaatactagcaagctgaattcaacaatacattaaaaagatcattcatcatgaccaagtggggtttatcccagtttcaacatatgctaatcaatcaatgtgatatatcatatcaacagaatgaaggataaaaactatatgatcatttcgattgatgctgaaaaaccttttgctaaaattcaacatcttcttatgattaaaaccctcaagaactgtatatagaaagaacatacctcaacagagtaaaatccatgtataacagacccacagttagtgttatacagaatgggaaaaaactgaaagcctttcctctaagctctagaacacaacaaagaactccaatgtcaccactggtattcaacatagtactgaagtccttcctagctagagctgttttctgtttgaaaagagaaagaaatacatggtgtccaaattggaaaggaaaaaatcaaattgtccttacttgcagatggtattatattatatttggtaaagcctaaacacttcaccataaaactgttagaactgataaacaaattcagtaaagatgcagaataaaaaatcaatataaatagtagcatttgtgtatgccaacatgaaacaatctgaaaaagaaaaaaagttcttccatttaatatagctacaaataaaacgaaatacaaaggaattaacttaaagaactgaaaaaaactctacaatgaaaattataaaacactgataaaagacattgaagatacaaaaaaaatgaagacattccatgttcaaggattgaaggaatcaatattgctaaaatgtccatactacccaaagcaatctacagattcaatgtaatccttgtcaaaataccaatgacattatttacaaaagtagaaaaagtaatcctatgatttatatggaactacaaaagaccccaactagccaaagatatcctgagcaaaaagaacaaaactggagaaaccacattacctgactttaaattatactacagggcaataacaaataaaacagcagggtgctggcataaaaacagatacctagaccaatggaacagaatagataacccagaaacaaatccttattttcaacaaagctgccaagaacatatattggagaaaaatcatctctttaataaatgatgctgggaaaagtggatatccatatgcaaaagaatgaaactagacccctatctcttgctatatgcaaaaatcaaatcaaaagggattaaaaacttaaatctaagacctcaaaccatgaaattactataagaaaacattggggaaaatcttcaggacattggactaggcaaagattttttgaataatactgcacaagcacaggcaaccaaagcaaaaatgggcaaatgggatcacatcagttaaaaagcttctgcatactaaaggaaacaatcaacaaagtgaaaagataacccacagaataggagaagatatttataaactacccatatgatgagaaactaataaccaaaatatagcagtagctataaaaactctataggaaaaaatacaataatctgatgttaaaaaggggaaaatatctgaacagacatttctcaaaagaagacaaatggcagacgggcatacgaaaaggtgctcaatgtcactgatcatcagagaaatgtaaatcaaaactgcaatgatatatcatctcacaccagttaaagtggcttatatccaaaagacaagcagtaacaaatgctggagagaatgtcaagaaaagggagccctggtacactgtcggtgagaatgtgaattattacaactgctatggagaacagtgtgaaaattcctcaaaaactgaaaatagagtgactatgcgatctagaaatcccacccctgggtatatacccaaaagaaaagaaatcagtatatcaaagggatagcttcactcccatgtttgttgcagcactgttcacaatagccaatagccaatatctggaagcaacctaagtgtccatcaacagatgaatgaataaagaaaatgtggtacatatacacaatggagtactggagccataagaaagaataagatcctgtcatttgcagcaacatggatgagactggaggtaattatgttaagtgaaataagccaggcacagaaatataaactttgcatgttctcacttatttgtgggaactaaaaattaaaacaattgaactcatggagagagcagaaggatggttaccagaaactgggaatggtagtggggatgtggtggggcagggagtgggaattgttaatgggtgaaaaaaataattagaaacaatgaataagacctagtatttgatagcacaaaagggtgactatagtcaataataacttaattgtacattgttaaataactaaaataatataattggattgtttctaacacaaaggataaatcttaaggggatggatatcccatttactatgacgatatacattgcatgcctgtatcaaagtatttcacatgccccataaatatatacacttactatgtacctacaaaaattaaaaataaaaaacattttaagaaccattacactaggtggcatacgccagatgcaaaaagaaaatattgtatgattccacttatatggtgtataaatacctagaattggaaaatttccctagaataggctcattcacagaaataaagtagattacagattaccaggggctggagggaatgaggagttattgcttaatatgtacagagtttctgtatggggtgatggaaaattctggaaatattggtgacacgacgatgcaaatgtaattaatgccactgaattgaatacttaaagatggttaaaatagcaaattttatattttttttactatactaaaacacccttatttacaaaacaaaaccctaggagacttttttatgaaatctacaaattgattgtgaaatacatattaaaatgtaaaggatccacaatagccaaaatcatttgaaaagaactaagttgcatgatttgatctgaagactcacagaaacactacaataatcaagacagcatagtattggtgttaaccgtagatgtattgatcaatagatgacagaatgtcagaaatagacacatatatgatcaattagcttctgacaaagtgccaagataatttaataggaagaaaaatgttttcaacatattgtatggaacatcaagatatgcatatgaatacataaactctgacctttcctcagatcatatacaaaattaacttatcaattacagacctaaatgtaaaaaatctcctaaaaggagaaaactttgcaaaaaaacccaaaagtgataaattatatcaattcgttaatatagaaatatagactataattacatgtgtttgtatacatacatgtgtccagaacttaataacctgaatcttagcaacaagaggacaaaaactcatttaaaaaactgtcaaaagatttgaacagacacttcataaaaatacaaaggccactaagtacatcaaaaaatgcacatttaaaccacatttagttaccattacaaagtcattagaatggctaaaaattaaaaggctagaacgagtggaattctcatacaatgctagttgcaaagtaaaatattgccactactttgtaaatctgtttggcagattcttataacgttgaacacatgtctgccatatgacccaacaattccaagagtaataatcatatgccaaccctgccacaataaccatatcagatttattcatagtagccacaaaactggaaaaaaacccaactatccatcagtatgtcaatggatagcccagttgtgatacatcctttcaatggaatactactaggcaatgataagagaatagagtattgttattatcattacatgcaattacatgaatgaatttcaaaaacatttttctgagcaaaaaaagataggcacactgtatcattccatttatatgaaactctaaaataagcaaaactaatctgtaatgacagagcacacatcattgattgcctggggttgtggctggtaggagagaggtgtgactacaaagtggcagaaagaacatttttggataataaaaagggtctatatctttatagtggtggtggttacataagtgtatacatttgtcaaaactcatcaaactagaatggatgcatgttgttaaatgtaaatcatgcctcagtaaagaagattttaagagtagaaataaggatctatacccattactgaatctacattatatacttgctgaggctgtgacagagtgcatcatcaacgcaatatggctaagcttacccacaagtaagctggaatgtgggtataaatcaagtttaaggataagcagaataccaggtaactggcaacaccagaaaaaatttcttcctcctacccagctgggaaatatccacagtcttttctactgcaatgtacatatcccagattaaacaagtttgagagtcaggagaacactatatgacatcttcctcctaaaagatgacaactgctcttggcagtgggtacttgagacagaatttaggaaacctctgccatggctagctctcgaagtataataattagtaaaccactttatctgggagtgataataagattttgtgcatttttgttactgccattgcctccttgaccaggacagtccactaatactcagtcttccacctccaaggtagtcctttaagaatttgttcagaaaccctaggtttcagccaggaatgattttaaaacattgaaagcataaccaagtgatggtgtatatattcctctttgcacagatataaatttattgtgcagtttttctatgttgtttaataaagttcactttctctagtgatcttacaggcaacttctaatactactactaccattaatactaatactatggttctcaaacactgcatgttcttaagtcaaattcccagaggtctggggaattggggtctaagatctggtctaacctctctctggtgatcctagtacagatagccttcaaacaatttgagaaacactgcactgttccattgctctgccagggacacttaactttttagtcctccagttaggtgggagtgagttgactgacaggctagataacaaccaaatacataatcaaaatcaaatgtatcataatgtactttcaacaagttgtccctcatgaagacatagcatgattatttttgcatgggacactttacaactgatggttgatgtttacttcgttaaatgaattttaaatacaagtggcattgattctataaacagcaacatcttaggaaaacatcctgtaaagaatctccacacttagctcctagagaatggtgacaaggactgcttaaaagaacatgaaatagtttggtgctatagattaaatttcttctgagaaaaagtgtgaattttacaggtggcatccagatggagaattagtcccttcccacccacatgaagaaagtctataaaacctcttccacaacaggagaagaaagggaggacattttgtgccaagaaatttttgcaatttgtgtactagaagagtactgcaactctctggagcactccatattatgtgtagctgtgtcgtgtcaaatagaacagatactaaactacagaaattgagttaatgaagaggtaacacgtcaaagtctaaacttgaacaatggtagacagactaattgttttctacaattatatctgcttttagttttgaaaatgaccaatccagcatgagccagcatgggtcagcataggatacagaagattactaaatagatgggaactaagaccataacagagagataatccaactacaaccagctagagatattcttagaatcttgtggttaagggttttaccaacaccttgacaattaactccaaaacaatatgtaggtgtatctgtacactatttatgaatttttctgtatatatacttacattaattaattgtttagttcaattttaacagttcattttgctgagtggagcccttcattctcagtaaattttttaaggactttataaacacatacattattaataaaaagtactcaaactaggcgaatccaatcaatagttgcaattatgatcagataagagcacttatttaaatagtggctcttaccttttaaaaatatttttatgaaaattcaccacaaatactttaataaaatgagttatatggatatgaattcaattactatagctctagaaccaggtgatgaaataacaaaatgaaacagaaagattgcagaagtaataaaacagagtgagtggcaaaagaatatcattaataaaataataagatcaaagaaatgaatagacaaggttgaaaactaaattactcactagaggaaacatttgagaaacatcacagtaatgcagataaaagacacagaaacaaaaacaattatttaaaagtaatatatacagaagatagaaaagataggtaagacaataaatgtgacagaaaatgtattaaaagatatggtacaacaaagcttcaccgatattgaggtaaaaaataaacctgtatattgaaaggacacgagaaattcctggaaaaatttataaatgatcatctgtaagaaagtgctttagtgaaattgtttttccccaactttaaggatgaagaaaaataacttggctatcagttcttgctatccatccttttacctatacatataaacacagagagatttccagaatcgtaaccttcaaaattataatgattatgtctagtaggtgaaatttgagttattacatgtttctctggactttcctctattgcttgtatatttataatgaacatatgttacttttataaaagcaatacagtcattaacttaaaaaattaaagaaggaaagaaagggatgaagaagaaaagaaggaaagagacaattattgatttgcctagatactattttatcactttcttagttacctaatcattacgaaagaggaagaaaaggaggagaaagaagaagaagataaagaggaaaaaaaccatcattttgtgctgatcacagattacgtatgtgaagtcttgggaatttctgcttatgtctgatatattacaactttactgctaggaacttttttttttttttttttggcctagtattttgaagtatctgaaagagaactccatatttgtagaagcccaactgggctactgttaaaaggggtttatattccataaatatttacattctgctctacaagagctgagaaacaacttgatgtgcctgttgttcccatttaaacaacaacaaaaaaaataaattgtgaatctttctctacatctagtatcttttctaccaggtctctggtagaatgtcaattccctgaaaacacagattgtgcttttgctttgttccagacaatatgtgtctttttagggtagaagtactaaaaaatgaaaaataaaatgctaagctaattgatggttatgatatattgtttcaatccccctaaggccaggctgtgaactatttcaaccagacatagtctccacaaagttgtagatctgagtgactctgccaagcatgattctatttgcaataagtcttttacagttatctactattttctcaatcactcccttgcatttaaggtttagcaactagttcactgtatacctctccacgactactccatgcactagctttagtaactccaatattccttatcctctttttctcctgtgttcacctaacaaactgaaactctgttaaaacccaactttctatctgctccctacttgcacctcagcagctggaagtagtcaaagaaaaacattcatttgaattaactgattttatgtaaacttttaggaaagaattttaagaaatgccttcattttcttaaatttatgaccacaaatcttagaaagacctccccaccacccagcatccttctatgtttccataacaaattcattttcccactctctcaaaaatttgttttacgtattttcctctggcctcaaagcctccctcaatactccctccttccaccgtccttcactctcatatgatgaccttgacttctgtttaactgaaaaactaaaagtaatcagaagaacatctcctgattttcccatcaccaaatcttctaacttacttgtaactgacccattcacttcatttttcctcctaatatgagggatgaaatctccttggtccatataaaccaactcttcacagcgcactgaattccagcaccaacatttaagaactttgcaactggaattttcccctcctttgctgcttcctcttcagttttcctctctcaattggatcatttccatttgcatgtaaacatgttgtaaaaagactctcaccttgcaaagcaaacaaacaaaacaaacttccttaattctatttgccccttcagcttccgtccatttatctgcttctttggcaaagggtatctactctacccgctttttctttaatccactccaatcagacgtctgtctccactactcccatgaactgttcgaatcaaggtcattaacaacctctatcttgccatatttgtgtctcaattattcagtctctcaagagtattaacttaatggagaatagcattgttgtcaaacactagctttgcttgacttcctgtgaagagtgctttactggttttcctcttcattctctggcattttcttttttcctcagtttccattgctggatcctcctctcaatattctccagagttcagtccttgaacgtcttctcttctttatacttagttctcaccagatagtctcaagttccattgtattatatgatatatacgcatcccctatttgatctgtttccctgaggagccctgactaatacaataacctttcctctttgcctcctatggagctctggaatcaactcaatgtggaagatgtctcaccagtgtcaatcctttccttctttcttagtaacagtcttttattttacgtagccagcctcagtctgtcaactgaagtcgagtagacactgggatccttgatggaaggtggaacccatctttccctaaaattctacgttggagagaaacaattccaattcctccccctagcaaaggcaaagagctgcaaactctttacccctttctttcagggccattattttccccagataatctcagaaatatttatatataaaattaatacaaattgctggttggcatggtagatacagtacttgttttcatttatgctaatgagttgccatttttgtttaattacccctcacctttttaaaactagagaatacattcatcactcatgactgtaggagagatttttatcttaatatggggggtaaaaatataagggtttctagtctgttttatgctctacttctttaaaaattttaattcttccataagaaaacatgttaccccttagggaaaaatccttgattcttcccatcactctgctttactttatattaataacttgtttcattaatttttactattaacttttgacttctagcaatgttttatcactagtggattgtttcagaccaccatagggtaatgtggtaaggattaacaccttaataaaagataataaatttttcgcattttttgaaagttcaggccaagacaattttcatgtaatcatagttagagaaagctttttcacctggcttttataaagatgccaagtgaaactctatattaaaatatgttatcaagtatctccttaacttaaactgatacacatagctgttacttaagaactccaacagaattataggactcagaagtcagagatgccccaatctagaagtcattgtaacagagctcctgttaaaactcctaacttccagtagttattgcagattaacaatgttcagagcattgccaagcttctacattgccataaaacactgtatttatacctaaaagagtcaatttaccagatcctcttaaaattataataggcacccagatcctgaaaatcacccacactacttgtcaggattaattgtttctttggctttcatacgaaagtgtaaaaacaatgaaacaaagaaagacaagcaagcagaggaaagtcagacttaagaggtacagtctctaccagttgctccatttttatctttctggcagaggctttaaataggtatttgattatatgatacaaagagtatagggttctttctagaatttctcatgtagacccaaatatccagccagggttgaacactatcttttcaacattaacatgataggtagaattttaaccataaccctcatgttgcaccacttagcaactgactgattcaaataatgagcttccttttagaaaatcttagaaacacttggatataagaatatgaaagaagaagaaaacatgccaaatgtcaaccatctatattttaaagtaaattcatgcttataaatactattaaaattctccctcatgcctcaggacctgggcactaaattgtttgcaatgcatttgtgaaaagtatgtgctgttctctaaattatttcaaactgtttgtgttttatgttgaaatttaatctcagtgtttgttcagacaaactattaaaagtaaaacatttacctaagccttgtttttgtcttgtaatggcatttctgcttgatttaatttaaatctgttatttttaagtcaattagtagtacaaaaacaatattcaaaagttccatggccattttaaaaacagcctctgttcccaggattataaagcatcaatcattggtcatgacagtatattctatatagttgaaggctgctttctatatagtgaaagtaaaatatatatccgttgctcatcaaagatgtcaactgctttgacttttccgcttttcaaatatgtttttatctacatcagtgtaataaatcatttataaaattctcattaagaagcattacataacacatgccaccatcttatctaacatttctaaatcatacacttcatttgcattctttcttcttttagtttgccaggctatgttgagccacataacttttcctgtagtgacaggggaaaccaatgatccagttttttttttttccatccctgcacaaaatcagtttgactttgattaatgtgacaccagtgggggcttgactaaattaactactactttacttgttaagaaatcaattctttcagctgagaatcaaactgattgtgtttcaagtatgacctagagtgatctttatcaacattaagagaaccagtccaaagcaatagctaaagaataaagtattttaaaaatggcctaaaaactcattagctgtatttacattaatttggaattttgatcatttatacctatgctcttctgagtttgttccataagacgctaaagtgttaatgaaacactttactcacatgtgtattgtaactatgtgggcacttcctagaatgacattctttacaaagcattaatgatacagaaagtataaacctgactcagtaagtggtacctcatagaaaacctcaacattgctcatgtaacccactgagcaggaaataaatgcaccgcaggaaaatggaagcttcactctaacctatgttcttaattctgagtatgttttaaagaaaagtaaaaatgaacagaaaatttttactttatcacaaaaattacagagtgctaaaatgtcacaaattactgccctactgatttggaattgtgaaaaatccagattttttttttctttgttgaagtttgtatttgatccagtatagaaagaagtcattctcctttaaattcttttcaacccgtatagcatggtcagaaataaggcttagtttagtatctatatgtctttttttttctttttgccatggagttgcactctgtcacccaggctggactgcagtggtgtgatcttggctcactgcaacctctgcttcctgggttcaaggatccccctgcctcagcctcccaagtaggtgggactacaggcatgcaccaccacacccaactaatttttgtatttttagtagtgtcagggtttcaccatgttggccaggctggtctcgaactcctgacctgaagtgatccgactgcctcagcctcccaaagtgctgggattataggcatgagccaccacacctggcttatatgtcttttatgttaatacttctctaatatttgccaaactctctttaagaaaatttatctcagcctcaatctccctcaaggcaacagaactggccaatatttaataatgtcattttcatcacattatattgatttttatagttgccttctgtttgcaacagagaatactggttttctgttcacggtactaatataagttttctctttaaatgaatttagattgcaaagtgaatcaatttaaagagaatattgggaaataaccgtacaggtggtaagcaagtatgtcaaaaaatcatgaaagtagtaaaaatggctggatgtcaggaagtaactatatataaaaccaaacaagaaaaaatatatacaaaactgtaaagagaaaaccatctatttgaacaaattaatttcaatccttttcccagtatttgcataatatcatgtttaattctaaatgatgtatttattaaagtgggaccattaaaacctttacccaacaacattgtgatagtttctcactcagtacaatataaactcaaaaactgtaaaattcagctccttagtgaaaaaattctgtaattcagaaacttcattgaacaaatgcttatcaatcactcagtatacccaacacagtgagccagatttgaggagggacaaaaacatttaggtatccactcattaattcaaaagctgttttttgagtagatatgatattcaaagccacttgttgtgtaggatttaatgaaagaaagagaaagaggagcagaaggaggaagaggaaaaggagggagaagaggaagagaaggaggaggaaagtaattattaaataagggtcctgaactcaaagagattaccatctagttcattattacttattattgtccttgagttttacttattatactatatcattttctcacatattatctcttttttaaaatccatgtattactcagtctgtggtaatatttaggagacatttcttttgaccatcagattctatgaaactcaataacaaattcatggaatacaaaatagcacaaccttaaaactcacagcaatacttacgaaattggacacccttggcctttcacatattctttgtgaaaggggagatgctgccccagaaaaagtagtcaacattcagtaaaataaactcactgtggtaacttgaacatatgcatttaatgagaatccacatgcaaagcataacttgaaggtttaactacataaattaaaattgttctaagctgttatccttcacaaatatagtgcttccaatttttactaaatttatacatctcacttaggatgtgcagttgtgatcatgatatataatgtttattaaactacttgcatatatagccgcctcttcttcctctttactctgtgcctgaagcctaatgaagacttctacaaaaaaagacaaaacctattgtgttctaaggaatagttgtagttttttaaaatatgaaaatagattgtgatgttcaacacttaaagcaaatttttcatttctgattcactgaagacagatttccaacaaaagctttataccatatgtactcacatatcactatttttaaaaattaaaatcttacagaaagattacaagacttccttcatatcctaaactttgtgtgatagtactttcttaccttctcagcctagaatgccttccttctgtattttaagtggatgatgcaactggcatgaatgctacagctgccctctaatccagcctctcatttgaattactttgtaccttccacaccaaaaaacttgagctggcaaatactaatatcagccacctgtgaatcgacattaatcatttcataacttaattgtcaccaacagtattgaaggaaaaacaacatttggtgtcaaagagactgaaccagaaaactggccctaaggaaatgtgagtgtagtgatcctagctgggaagctctctgcgcttaactgtcaactcacctggattctgggctaactctgtttcctctgcagaaaatgaaaaaatatgagatccaagcacctgcaactcctcaaatccacctgaagccaatccatctgtgttccaataacccaggcctaggtttccttctgacaagatcgatttctacttggttctatagttctactatatgcatcctttgctgtcttttcttctcattctgtatacccggtgtgcccaatactgtgctagcaataagaaacaaagaagagcaagtctctcagagcagggatgcacactaattcctaggatttcagtatcttatgtgacagctttatctaattttcctttccataaaagtataaatattttaattttttgcaatgtgaaaaaaatttaaatactccataattgcaggcatttgggccttccgctctacttaaatagcatttttactgccttggatgtcataatgaaagcatttgcttatttttcttgcaatgtttttccttcagttcacatcacagcttctatgatggtcttgggttgctggcttccttaatggtgccatcatatagaatcactggagtttcctggtaattggaaataaatacttcaaaattattttaccatgaagctatttttaatattctgtaagatttgtcacttcccttttattccttttacaccttatttaaggagaaaataatatccttgcttcaggaaaaagaaaaaagagaagatttccattgtttctatcacaaatccaaaatattctcaagggtttagaaggtgtattagcatcttattgtttagtcctactgcagccttcttgcagccagaaggggaaacactattcacacacagagggtggcagagaggggacgagaaacagcttggggtcattgaggtcattgctaagacagtgaaccagctctgggcctcttatttctagactttctgttaagtaaatgataatgatccttgtggttgaaaccacttttaatcaggaatgcttttacctgatacccaaagttaccctgatatccctataaacacagcttgatcagttaactagttcaatcaaggatgggtgggaggactcacaggctggagcagagaggcggccagtttcaagtgatgcccattctgggcttcccaatccagttttctctgagctgttttctgtagttgggttttctacagtgaacataaactgtcaacctctgctcagagagtcatgacagcagaggcatggagaccagcagaatgacctcacctccaccttctcccctagtgtaaacacttgacccatggctactacctaatccacaaaggggaaaggaaggcaggtgcctgtggaccacatttcctatggaaatgctataaacaggagtgtcctggctaactggctctctggtggggatgggggatgggggatgggggatgggggcagtgggcagggatgaagagttaccctgatgtgtagcctttcccaagttttgtggtataagtaatcttaccatagatgtcaaactgctaacagatcagtaacctgctgacaatattcctgaacatttaactattgactctggaaagccagataataatttaatgagttctttttcaggagctgtttttgtttttgagagaatcctgtgaactaagagggaactctactgaaggaatgtcaagcataaaacctataatcaaatcctctcttcatggagcttatagtccagctgcaagttcagcaacatgcaatacagaagcaagaatcacttgcttataaggtaagatgattataaatgcaaattaatgtaaagcaaattgacatataagcacctaagacaaagtgcatcagcccatctcataaggtggctgaaaggtccaaatgagattgtagatgagaagactcttggtgagttatgggccacagcagaaatgtaaaggatcattcctcttggtgtgcagtgaggataatcagacaaggcaccatctggattcccagaacatggtaattgataatgacaaggtcaaagatggaaaggcagaatgcctggggatactgagaagacagagaagcaaataggggccgctggcctcaaagacagtggagcaaattgtgttcaccgatccaaattattttctagcacaccatcgctgcctttttcatcccatttattatataaccatgaccaagactttaacttatctagtactcaaaagctccacctgcgaaagtgtcttcaaggggctgcttttaggatattcaggatgaagacctaaatgatcttcagaatagccttctacaaattcaatgtctcatcatgacttagtaggttagcagcacggcctttgggactgaattctgactctgccacttgctagctgtgtgccttgtgtaagtaacttaaactctcagtgcctcagtttcctcatctgtaaatggagatggtaatatttaactcataatacggttgtgcagattaaacagacataaatataaattacctaggacaatgcctagcacatagtaagaactctatagctgatagatattattggtattgattttaagagtataacattcaaaatttggcttaaaattcttaaatggtaaagaaattataggcaattaaattagttttgccacctgcctttaaataagatggttctaaattggctaggatgctttctttctgccacttagagtgtcaacttcaacttaagtgtggccttcctgtgaaggaaagtcagttgacgagtagcaagaaccgcttcatacttcaggcacatccaacatgggaggggagaaaggaaagagaaggagagagagagagagagaaagagagagagaagaagaagaagaggaagaagaaggagaagaggaagaagaagaagaaagaagaagaagaagaagaagaagaagaagaagaagaagaagaagaagaagaagaagaagaagaagaaagaaagaaggagaagaaggagaagaaggagaaggagaaggaagaaggagaagaaggagaaggagaaggaagaaggaagaaggaagaaggagaaggagaaggagaaggagaagaagaagaagaagaagaagaagaagaagaagaagaagaagaagaagaagaagaagaagaagaagaagaagaagaagaagaaaagagagagagagagagagagagaatgaacatgaaccaaagaagaaagaggaagagtcattctgagcatccaatatatgtgtcctcctattacatcacatagaccaaaccactgtgtccagagatttgtgatatgctgataggatggagctggaatgtttctttgggaaaacggaggttcaagtaggaagagaaaaaggtaaggggatggatactaggctgttaacctacaaatggcaagtatagttttaaagccattttctgtattcatctgttgaccttaaaccataaggtacaggctattcaacaataggcatgatttgtactttcactgttcgcaattccgaccactaccctattacatctaaaacatgaatctggctgcttatccttggattttctacctccataaaatgataaagagaatgttccttatatacagaatacctgagctttaccagcaccaggactggttgttactctatgtttttgatagagctgattttcctatttcattagggagacatatatcaacatacagaaggttgatgtataaaaaagaaataagcccaaccagctgaaagaggaagaacttaatttattgctgaatagtgacaatcaattcaaatgattttagttgaactgacattaaattataacctcttggtttaagacatttgagagaatgagatccaaagaaaaagattgggcatatttttaaaaattccttgaatatctcttattcactgtttttgccatacaaacaagcttagatatttgacttaacactgccctagttctcaagcctctagtttctcttcatgacagtagctttctattatgatagatgaaaacccaaataacatttattctatcctattggaaaacacatgaaaatgtccaggggagaagcatctctaaaaataataaatgaaatacatccaccaataaagaggaatagaatcgtggtctctgatctcctttttgaggcactattcctcccacgggagttagactgtagcagaaatctaagcatggccctaattcctacattccaatcctagatacactaaaaggagcagaaccaggtgaagtaaacttaaaaggaaacaaagtctttatgcattccaaaaacaacacttttctctgtgtgtaatccccataatcaaattgatgcttgaatgacaaagcaagaaaaatgatataaaattggggaaattaagaatgatataatcgtgttactgcctctgtgccctatatatctaaatatgtatctatcaaaaaacctctccaacagaacatggtgacagagataaatttcagtttgacaaatgcaccaaacaaaaaatgaaatgtatcataaaccattgctctttctcaatccaaacagaaaaaaattcctaaagaaacctgcattctttataataactagggtaatgtatgatgtgttctctcaatttctgaaatactatgtaagtcacgaatctaaagccatgcaaaagttatacattcacaatatgcttgtagaagattcatgttaaatgtggctttgctcatagttttttaaaactggtagttttgactacaaatactaaaataaagtttattaaaattttttcacttttcaaacaatcatcttagtatagagacactgccttattcatttattcattcaatatattcagataattcactattttctataaaagaaaaatgcccatcttgattaatgagatcatctatgaagcaattgtgctaactttcctaagtttcatacctattaatttcaaaaaatttccactaatttctgcattataagatcgattgaatgggaacatctaatctgtctttacaaaaccctttattactgcaactataatctgtagattttaatactgttttctgatattttcatcaatactgcagaagttgtccatatctatcacaaaattcacgacctattttaagtagctaagttctcttaaattttactacaaagtaatcccaaattatctaaattgattattccatgagtcatgagcaccaaaacatggtatataaatgagtgtactgcttgatggagaacattgatcagctgactcctgttcacccttgatcttgccatcccacatgtaccagcacccacaaccctacacgttgtactcctaggtgatggcaataagaatacagaacagctagagctatttgccaagctgcagaaatagcccttggtgatataaataaatgatgtcacaaatgacaccaagttttcaagcttaagtagctagaagaaggtgtcatcattttcaaagaagaaggtgtcatctttttcagaggctagaaaattgagatggggagctgatgcatgtcatttggaacttcttgagtgtggggtgatggagaggcattccagttaaaaagcagtaggcagtcagatgtgtgataactgaaacctgagtaagaaaactgggatggaaatgtaaagataatactcatctgagagaggggaagattaatccagagagagagaagcagggacagaaaaatagaaatataaatgaatggatgaatattaacgaaaatacttaaataatgcttaaagtgagaacagagtaagaggatgaaaagaaatgcatttttttaaaaaagaaaaaacaggaaagaaaatccaacaaaatatattcattattaatttattcaaatatttattgagaatccactttatcctaggcaccgtgttagacactggggcaaggaggaatatacagattcaaagtaaatatggccgctggcctcaaggaatttatagcctagtgaagaacagagcaaagcactggacaaataacacacacatacacacatacagaccaataagagtaattgtaataaatacgcaaaaaagaaaaaaatcaaaaacaaaaacaaggtccaggtgctgggcatatataaagggcagctgcctcactttgcctggagtgttagagaaagttacactaagaaaatgacatacctggcaaatgagtaataaaaaataataataaggaaaagtgatcaccaaagtcagagggagcagagtcagcaaaacaccaaggaagagaagaggaaaacacacaatggagagcaataaagagccccctgaaaatcttaaagtggctttttttttttttttttaccatttcctcctccatttaccatcctagtccaaaagccaagtgtaagcaggcagttcagggctagggtttgggtcagggtggacactgctaacttgttacccaatacacattcaccagttctacctactaacagaaccccacattttttaaggtagcaatgagcctagacaaattactaattttgccggcctgccttgtagctaggggtgactatgacaactcagaccaaaaagtcatatgcaggaggctgctaaggattaccaggaagttttgctttcccaatggtaacacagcccctttctgcttgacacctgattttctttttcttaccttgaacaacaggttggaagtggatcagtcatcttgtaacatgaggcaaccataagaatgaaagccacgtactaaggaagacaaaagggaaaaacagacgacactagagctttgagggcatcctggagccactgcatcagttccagactgtctagctgtacactttgttacgtgagaaaagcagactcctatatggttaagtcagtgtagaccagtttcttttacttgaaatcaaatacaatccctagctgatacagggttgtagtgggatgggaggaggagttattattgttaaggaagtgatcaaagtagggatgacatatacagaaacaaaaatagaaaccatttcaagtccctttttacaatatagacacagttactacacaaacacatgggataatcaaactatacaatgaatgtgttaccttatttaggataaggctttagaattataaacgttatctcttggaagctttgtagctttaaactattgaaaactggtatatttaaagacacagttgtcacatcataacattgtccttaaaaacaaactttctccattgctgtatatgactcaagaccatctgagaaggtaatgggagtgttgttctgagagctcagccaggtgctatagcaaatggttagacatttaaatagcattatttatcataagtaacatgaaagaattatcttacagtctgattccaaaatgtatgtcaatttggcagtaaaccagtgcctttttaattataaagcataaatagatttctaacatttttcttttcctaattatacacactgatttgtcatgacactgccattttgcaggatatgtaaaaatcagctctggccagcttgaacaagtattacaaacaccaagaatcattacacgggcacactctataacattgtccattgccgcacaaatttcactgtaaggtgtgtccaatctgatacagctttgaagtcaaaaaccttaagatttgaatcttatctctattgaatgctaattatgttacccaaagcaagtcacccaatctgtctgagctttggtttcctgaatacctatattttgtgagtattaaatgagatcctttataaacaaacacaatgagcacaaaggcctatctacaccactgcaagctctctgcaaacattatctcctttctcttttgccctttctctacactgaactacatttgaggaattttcattaaaagaaacagaagtaaaagctagtaaaattcattcctacagaacagatcccaacctaattaagtgtaacacaaaaagtgagtttctacttaaattctgaggcaaagattataaatacacagaagcccaaatgtggcaattgtgcctattatcagaatagcatgcagaccataaaaagaatattttaaggactgtttccattttcaaaaggctagtaagttagtattatgtaatcacaaagctatgctagaaaagaactttcagcagtcactctcattttcccaaaaatacagtgtgggtcatatgcctgggcacagccctgagcagagagaggttgcacttgggggtagtgctccctgatgaattcaccctgctctcatctttctgtgatctctcacattcacagctgtccatctccctcaccttgaaccagcacagaaataaagaaaacaaacatctcccctaggagagcagccagaagccccttaccaagcatcacctccctgatgagttgtctttctgactatttcacttcttttagggcagtctggcaggcaagggacagtaagaacaaaatgtttataactctagtgataaaacagtagccacaatcatggatacttagaattcatattttcctgcaggaactaggtgtgaatggtatcatcatcttggccaagctcaaaaatgcccattcatttaatacaaatgtgttacctcactggttccctcctaagaaggtgaggggaagaaccatcatcacctagccttgtaattattcagattacatttcgttttatgtgacagtggtcaaatttgtattattcttctgttgccctaattatcatcataaatcaggaaacaagaatctcaatgtccaattaccattcagaatagatagagataggaaattaaagctccttttaagtgggagaaagggcaattccacagagcttcccttagctaagggaatggatactgtgctgaatagtacattattgaagaagagataagcgattgtgtgatgtgcaattgccaacactttctattctttcaactttagttttaaatgcttacaaggaataacatcttcacatttttcaaaaggctgctacaggagaaagccacttatgctcacttatattcacaagtattgcaaatacagcaaattattacttaaagaagaaagaggaagagacacagagaccaaaagaaacagaaagactctgaagtcttggcttccacactgtataggactttggccaggaatgttttccactgaaaccctgccctcactactatcctacacctccccagctgcttcctttaaggaactgaagccagaaaggtactgcagagggaaattttttttaaagaaatcaacttctcagaaatataataagcccaagcctaaactgttgttttctctccttggtaatttttatttttctaatgataaaagtggctactaagtgatgatactaatttccagcaatttaactatatgttacttctcaatgtactcattacagctatgtcactgtaggtggtataaaaaggtgagtcaatccagttgtttggacagttcaatcaatgactcaaagtggtagatcttgtaactctgtttaattacacctaaattaaatatccctagtagactttattcagaaaaagacaatacacatctgtgatgtcactagaaaaatctacttgccatgctcttaaaacagggacctcagctattgacataaaaacatttttagaaaaaagatttagccacacaactagtaatagttattaagtttgttagactgaatccaaccatttttaaggtggtaaatacaagattagattcagattagaaaggatactagaaaatacaatgaaaagatatgtgcaatttttatgtctctgactttagaggattttttaacaattttgtgtccttccatttcagtttcataattgagttgaatgccgatgaaacaatatgtcatccaaacctaagtcctatgttgtaggtgattaataattgatgacaatattaaaactgctcttatcagttctaacttttctggctaggaactagctggctcacagcccaaacatcatagtaagccatagttaaaactgcctttggatcttattagaataacaccacttattttcttcctttgaactgataatgtttctttttttttttttccaatacaaattttattatggcagcacaggtcactgtgtggtaactgtctgaactctaagcaatcttggaagcagtggttcttaagtatagttccaatgtggtctgtaaggatcttctagatgtttgaaggatttgtccaaaatttaattcatttaaaaatggagatgtatttaaatatataaatcagtttccattgcaaatgtcaacttataaaagacaaaatattatttttttaaatttaatgactataataattctttaccctacccaaagcaccacagaccactcatgcacccaaccctgacaggggaagagagatggagaggcatgggggtggagggaggaatggggtggggaatgaagggagaataagggatttcgcttcaggccaaaaggtatgtaagaataggttgggtccacagtttccaagatcatgacttctaggaagaagcatatgaatcaggaaagaaagacatcagagacagaaagagaatactttttactaatcaaaaaaatctcattaattgtaatgcaagagtattatacttgtaatgcaagagtattatacttttctgtacattttgtttcaccaatcacctaaattttacagctttttacaataactagaaggcagtgtagcatagtgacttcagtccaaaacccagttctcccacttaatttctctaagcttcagtttccccatctataaaatgagagcaagatctatattatgagaacatgtttttaaatacctagcaagatgctcaattgacggtagtaacataataaattagagtaggtgactttctagaaacccagctatgccccctcgccttagtcttgtgtggtctagcattggtgtgaagtaactgcacacttccacttacagggtgatttttctaataccctgaaaggatacttttatgttttcggtagtactttggttttcccaactgttttcttcataacgggttttctcggcttttatcacaggtgttttttctttatttagaagaaaatttaaacaattataaaacgttgtttattcatccattatttatagtttattattatggcaaatctatttttaaggctttgttatgaattagtgccaacaaccctcagaacaaaatttaaacaattataaaatgttctttattcatccattatttatagtttcttattatggcaaaacctatttttaagtctttgttatcaattagtgccaacaaccctcatgttattcatagaaccacacagtatgcaaaagggacagacactgaaaatactttccaactgtacataaaagaggttaattttcaaacccggacagtggtatttaaggagaaaatttgtctccaaatactcacaacagctagtcatattctaaaacctaaaaccatgattatttctcctttaagttttaaactattaattttacatttcaaagggatgttagcttagagccaaaaggttttgatcatttcatcaactaaaaactgtaaaactgaattcatggaaacaaaccccccaaaaatctccttggctgacaaaaatttccaatttcaaatccacagtcatccttcattcagtgtttgcacagctccatggaatcttgtttgctcattaaagtgaggccctccataaatagaaaaactacattggaacccactatgtaacacaaaatttctaaatattaaaagccataccatctgaagggcattttagaaaatgatcagtaatttttctaagatgtattcctgacactgcctgtaacttcaaaatatctctgcatgtagggaggactatttcacgtgttccttttgatattaaagtcttttctccaaggctaggcctgtaaataaagtaataaagtagcttttttaaaagagggaatttagtcaaatatggaactggttttacatcactgcactgctactcatttgcttgacgaaattgatagcttgtcaagtcttgtatttggctattaacagctgccacctcttctacagcattgctggtgcatattcttataaggattaaataaggtaagattaattaatatgcctggcccagggcatggcacttagtgagcactgaggacatgacagctgttaatattttaatagcaattatttcacaattgctatgaagctaagggagacagaaagatttgtccagcattcaccatcaggggtttccactgttttctggggcctattctgtattcatcattaacaatgacaacaacaattgagatgttaatacgatagtcagaaaatagagctagttactgtggaactgggtctccctgtttccacactcgtcctgtcctctccattcttcatatgtcactcaaaagcatccttctaacacacaagagacgacatctctttgctgactgaaaccctccagagacttcacactgagaataaaataaaatccaaactttcctgtggcccacaaggtctcccagaaattgatccctgacctcatcacatatcaggtcttccctccttcgagtcacactggacttatattcctggttttagcacctgctgttgcctttgcctgcagagctcactcatgttttcacatggctgggtccttcttttcatgcagacatcagctccaaaaggccacctcctcagggcaaccccaccacaccctacctagaaaagcctcatccctcccactccactgccctgcccttcatacgatctcaccaattccattttatttccttcacttcctcctatgtttttgttgttgtttttatttatgtaataattttatggaaaaatctctgcttacgaggacataaacataaggccatttcccctaacagtgctatgtcaactcccccttcctgagaggaatcagctcctttgtagaaacttggccaaatcctatagcttctcagccacttgagcctaagagcagtcccactttgacatttaagacttggccctattcattttaaaatatccatctcaaaatttattcaaatctaggctcttcctgttcccagaacaaggtagactacagggtcttttgatagagagtggagtgaaatcccctctttttacacacttcttttcataatctccttaaacttcttactcttctttcctcagacactagacccttggggaccatcaataccagccaccatacccaggagaaaagctgcatgaaggaagagactctttattttctattttgcttgactgctatgaaacaacaatattgtcccccatccttttccttgccaaagtgcagtgttttagctccgctatgtgctagtttagagactgggagctgcctctcttttagtcccacagtccatttgttcatttattcacatgaacaaacatgtactggatgctttgtatgtgccaggccctgtgctaggtgcaggaacaaacatttcttggagtttcctgtatcttcaatatttacatttattttttttcaagttgtgtaccactcactggaagtcaatatcctgtccagagacagtccacaagggagctggcgaaaagcagactctattttctctattagctgtatcattgtcattctgaaaaatagaggagctaggcttgctcccagtagaagcaactagagctactttaatttaacaattagaatcatatcatttctaggtgatttatatatatatactttaagttctagggtacatgggcacaaggtgaaggtttgttacataggtatacatgtaccatgttggtttgctgcacccatcaactcatcatttacattaggtatttctcctaatgttatccctcccccagccccctgccccctgacaggccctgatgtgtgatgttcccctccctgtgtccttgtgttctcattgttcaactcccagttatgagtgagaacatgtggtgcttggttttctgtccttgtgatattttgctgagaatggtttccagctacatccatgtccgtgcaaaggacacaaactcatccttttatatggctgcatagtattccatggtgtatatgtgccacattttctttatccagtctatcattgttggacatttgggttggttccaagtctttgctattgggaatagtgccacaataaacatacgtgtgcatgtgtctttatagtagaatgatttataatcctttgggtatatacccagtaatgagattgctgggtcaaatggtatttctagttctagatccctgaggaatcgccacactgtcttccacaatggttgaactaatttacactcccaccaacagtgtaaaagcattcccatttctccacattctctccagcatctgttgtttcctgacgttttaatgattgccattctaactggcatgagatggtatctcattgtggttttgatttgcctttctctgatgaccagtgatgatgagcattttttcatgtgttttttggctgcataaatgtcttcttttgagaagtgtctgttcatatcctttgcccactttttgatggttttttcttgtaaatttgtttaagttctttgtagattctggatattagtgccttgccagatgggtggattgcaaaacttttctcccattctgtaggttgcctgttcactctgatgatagttgcttctgctgtgcagaagctctttaattagatcccatttgtcaattttggcttttgtcatcattgcttttggtgttttagtcatgaagtctttgcccatgcctatgtcctgaatggtattgtctaggttttcttctacggtttttatggttttaggtcttacatttaagtctttaatccatcttgaattaatttttgtataaggtataaggaaggaatccagtttcagctttctacatatggctagccagttttcctagcaccacttattaaatagggaatcctttccccattgcttgttttcaacaggtttgtcaaagatcagatggttgtagatgtgtggtgttatttctgaggactttgttctgtcccattggtctatatatctgttttggtaccagtaccatgctgttttggttaccgcagccttgtagtatagtttgaagtcaggtagcgtgatgcctccagctttgttctttttgcttaggattgtcttggctatgcaggctcttttttggttccatatgaaatttaaagtagttttttccaattctttgaagaaagtcagtggtagcttgacagggatagcattgaatctataaatcaccttgggcagtatggcctttttcacaatattaattcttcctatccatgagcatggaatgttcttccatttgtttgtgttctcttttacttcatcgatcagtggtttgtaattctccttgaagaagtccttcacattccttctaagtttgattcctaggtattttattctctttgaagcaattgtgaatgggagttcactcacgatttggctgtttgtctgttattggtttataggagtgcttgtgatttttgcacattgattttgtatgctgagactttgctgaagttgcttatcagcttaaggagattttgggctgagactatgggattttctaaatatacaatcatgtcatctgcaaacagagacaaattgacttcctcttttcctaattgaatagtctttatttctttctcttgcctgattgccctggccagaacttccaatattatgttgaatatgagtggtgagagaggtcctccttgtcttgtgttggttttcaaagggaatgactccagtttttgcccattcactacaatattggctgtgggtctgtcataaatagctcttattttgagatacattacctccatacctagtttattgagaatttttagcatgaaaggctgttgaattttgtcaaaggacttttctgcatctactgagataatcatgtggtttttgtcattggttctgtttatgtgacagattatgtttattgatttttgaatgttgaaccagccttgcttgcatcccagggatgaagccaacttgatcatggcagataagctctttgatgtgctgctggattcagtttgccagtattttattaaggattttcgcattgatgttcatcagggatattggcctaaaatcctctttttttgttgtgtctctgccaggctttgttgtcaggatgatgctggcctcataaaatgagttagggaggattccctctttttctattgattggaatagtttcagaaggagtggtaccagctcttctttgtacctgtggtagaatttggctgtgaatctgtctggtcctggactttttttggttggtaggctattaatgattgcctcaatttcagaacctgttattggtctattcagagatccaacttcttcctggtttagtcttgggaaggtatatgtgtccaggaatttatcgatttcttctagattttctagtttatttgcatagaggtgtttatagtattctctgatgatagtttgtatttctgtgggattggtggtgatatccccttttatcattttttattgcatctatttgatccttctttcttttcttattagtcttgctagcagtctatcaattttgttgatcttttcaaaaacccacctcctggattcattgattttttgaagggttttttttgtgtgtctctatctcctttcagttctgctctgatcttagttatttcttgtcttctgctagcttttgaatttgtttgctcttgcttctctagttcttttaattgtgatgttagggtgtcaattttagatctttcctgctttcttttgtgggcatttagtgctataaatttccctctacacactgctttaaatgtgtcccagagattctggtacgttgtgtctttgttctcattggtttcaaagaacatctttatttctgtcttcatttcattatttacccagtagttattcaggagcagattgttcagtttccatgtatctgtgtggttttgagtgagtttcttaatcctgagttctaatttgattgaactgcggtcggacagacagtttgttatgatttctcttcttttgcatttgctgaggagtgttttacttccaattatgtggtcaattttagaataagtgcaatgtggtgctgagaatgtatattctgttgatttgaggtggagagatctgtagatgtctattaggtctgcttggcgcagagctgagttcaagtcctggatatccttgttaattttctgtctcattgatctgtctaatattgacagtggtgtgttaaagtctcccattattattgtgtgggagtctaagtctctttgtaggtctctaagaacttgctttatgaatctgggtgctcctgtattgggtgcatatatatttaggatagttagctcttcttgttgaatggatccctttaccattatttaatgcccttctttgcctcttttgatctttgttggtttaaagtctgttttatcagagaccaggattgcaacctctgcttttttttttctttccatttgcttggtagatcttcctccatccctttattttgagcctatgtttgtctttgcatttgagatgggtctcctgaatacagcacaccagtgggtcttgactctttacccaatttgccaggctgagagatggggagcctccttgttagataaagttccatttttaatagactttattttttagagttttagttttacagcacaattgatcaaaaagtacagagttcttatatgtcctctgtcccccaacctcaccatacaacaaacacacaacctaccccattatcaacactcaaaagattctttttatgtgcctggcgaataaaaggtgttcaaggttttatgctgagtcagtatagtcttgaccaagaaatctgcccaggtgaggagtggggttttctgaaggcagcaccctctctgctacccttccagggggtggcgatgattcttttgcctttcctcaagttgagtgcttcaaactcctactcctacacattggtccagctcctgcaccttggccactccccagatgcctacaagtggagctgctctaacacctgaggtcttctccctcatgggaggaaaggggatagctcagctctgaaaaagcactccccagaaggttcacccctcccagtcttcttatactgactggtgcaggtgggcttagtggtaaggttggttcttacccagtgcctctcaataaatacttcaagagagctattccaggggccagtagcaccttcaacttagaaaaaggggcacttaattttctggtcctcaactttgagccaaagccccaattctaggactaacgggggaataccgttgatatgtatcagtttactctctgtttatctcaactcattcttttattaatcttcaccatctcagtctatcctcagcacctagaacagtgtctgacacataatagtactcattaaagatctgttaaatgaattctatttggaacacttctaaaccagggaattaactacatcctaatgaaacccataacatgctgaatagtactggtagttcaaaataaaaagaatctcgtgtccatttagctaaaatgtgcatctatttaacctatttcggccaacttaacaacaggaaaactactttttttcctacatgacatcccttttaaatgttcttggatagaaaggatgtccccgactcctctttttcaccaggcttctaatgttacatggtttccagacccactgaccatcttggctgaccctctctgaagaattaatattacttttaagatgtggtctaccagtgaagagcagctggactataacttcctaagagctggacaatcctcttctgttaatgcaggttgcacttgcattaggtttggggcatttgttatataggattaatttcttcagcagaggaaccacacagttggttcacatcaagccaactgtgtggtcaacacaaaccccaggttttctttatgtagattactgtcaaatcagacctccacatcctgtattggttcaagtcacttcctgaaatataaatgctgaatcttaaatttagctccactacatttcttccttttgtttttttccccttgtttcagtatctagaggctttaaaaatgttggtatcatattatttgtcattatctgcaaatttgacaaacatatttctctatgtccctatttatactatttttttaaattatttattttcaattacctgaagagaatggagccaaccaagagccctgaaatgttctagagacctccatctggattggccctttttgaacatggctgctcctcccactgcaaatccacctaaatccatctaatggtgccctcatgcagttcacatttttattgtatctctctgttacaaactctaaagcttttaagaaatactctgttgaaataaaaatacagtacatcaacaaattaataagatcaccttattctcaaaggtatgtttatgttagtgcaatatatgtatagagttcacttattttcttcataaaaaaatcatcgagttatctgctaaagcactaaaaactatcctaacatcaatactgttgttctgaacttccaaaaatctttgtacctttgttgaaaatctcaatacctctccatcttcagattcttcttaagctccataagtgcctgcagaactccaccatttccagggccaaatcttcacattctttaatacctaagaagttctacatctgtgtctggggcagtgacagtgcctagaccttctattttctcctcatctaccttaggaattaattagttgttcatattcatatgtcttgtcctccctgtcccaatttgaagattattagctcttctagaaagaaaaaaatagaagtaaatgaagatgtgaattggtctttcttttctccatatctatcctatcacaccatcatgtccaagtggtgaacctattcttttactattcctgttattccaaatttaaatctaaaatatatttcatggttcagcacttttcaaagctacagtttgttctctttgtgaggcccagtgacaccactgtgctcatcccaggaacttaatcctcacagacatgctccaacagctctcacactttctactttagcgtttcctgtaactgtgcattgctatttccctcaggactcctgctccaggacactgtcacattcaactcactttcactggttgggtgactggcctctagcagcatttcagaggagtgagctctttttgcccatccgtccacacccccatcaggtcacactcctgggacactcaaattgtgcagtctaccaccaaagaagactattccaaccatctttctagcaatgctctgctccttatagaaaattgaagccctgtactttgtaaaggttcatttactgtctcaatttggggtacttaaaaaatcaatagcaatcttaattcccaccagagataaatagcccaaatctttaactatgcatgaacaggggaaatttaagaaaatataaaaagaccacatagccctcaaatcatccattccctttgcagaactccaactctccccagtatggatctcttccagatttgggtacaagaggggatgactaacagcttgtggtttttttctataagataagaaggataaaagttttctatttttaaattttatttttgcttttttgttgttgttatttctactaaatgctgaattgaaaagcatcttttgctgtacaatctagagagaaaggcttctatctaaaacttctcccaaaggccattctagatatccttaatcagtggatctccagaaactaccctgaggcctttcgtttccttttttttttttttctaacatggtatcttgttttaataatattttcttgagcatagtgacaagaattttttcagatgttatttttgtctcctggtctgttgctttatttttttaactcaatttacaatgtttcctccacttaaaaattataaaaatcttcttctgtgttaacttctaattcttttgatctatagacctacgtaacatatgctttaatcagattgaatagcaatattctctttctttggcttcatttctccagcctaaaaatcttcagcttttaatttttttttaagtttttcccaatgttccatattacaagccttacattattcttgagacttactccaaataatctctatggcccctatgtcagattaggacacctatatctctagtaataatattaattataattgtaagtagtagaaatatctaaacatttattgagcacctatgtaccatgaactgatcagctcattttacctgtaccacttcatttaaaccttacaaaaattttattttacagatgagaaaactgaagatttaaaaggttaagtagtttgctcaaagttatagaaatcatgtatgttagaaccagaattcaaacctggaaagctgggttctttctccaaatctcatgtacctcatcatggctttctattgattatgcagaacactatatacacttctcccacaaacctttagatagaagggactttcctaagtattaaaccacaactcctatgttttaagagatatagagaacaatcaccctcatataaattctggacacataaaaagaatagactccattaataatgaaagctaaaatcacatgtgtaaacacattgcttttaatctattcaattatttccccataagcactaactgtgcatcacaaattatggtgtctaaaagacataccacaagagttaaagctgggaagattcattgtcattctctaatggaatagttttctgaaagaatgaaaattctgaatctctaagatggaatgcctccatccactgtttctttatcctgtttatcaaattggggaaggaaatgcaagacaaactacacagtgatatcactgcataattaattggtacatctctaccagttacatataaatacattttcttttcatgtactttaatttaggagttgcaaaccaaccatgctaagcagccaaattcagcctgcagaaaagccttaattgtcttacacaaatgcatggacagtctccagtttgccattggcaatactattccctattgtgtcacagctggcctgttatgatatgtttatatagcttgtaacaaccactataggcatttgagtttatgacccttgagcagatcaaatgactacagacagtaagataaaagcccatattacagacctcattatctgtactacaggtacactgccccaaaataaacttaagaggtaaagcagctaatccactgcacaaaaaaccaacagttgctctgctatactaaccttattccccctgttccttcccttttccctcttcatatccagacctaaatggcaaagtttatctttgtgcttgttgttgactcaagttcagactaggaggctgcagagtcagattacaaaattggttatacaatctatgtcacagaggtacatccctgaccttacacaaattcagtgttttcactagtacaagctccaggggataaaagcaaaattgtactcactttatccctcaaataactctgaacattgctgtagagtagatcatggagacaaaattggttttttggaaaagaaaagaactaaatatcattctttcctccctaaaaatagcactactgtaggaaatctcataaaactctgaactttcactcaagccatttcaaaagtgattggttggggtgggcatgaaaaaaaatatctgcagagctttaaaagcaaatatttttaaaagctaggaaagtgagcatggtcataaacgaaagcagctcagtttagattggttgccagtaaatagccagaaaaagaacttcagccttcaaaaagagatttcaaatacatctttgtatcactgaaataatgccaatgttggaaatatttgaaaatatttgcagagctgtattttagacaacgaatgatactccataaaaaacaattcttttcccactgtggggcagaatgtcaaaacatgacaagatcactagcccagatcccctggaaaacaccatagaatcatttcaaaggcaagagattacaatgatatttgccttgttaaggctgtgtctatacggtgccagcaaacccttgattaggttgattcactcaagcaaccagtcgatttcgtgaaacatttactcaggcctgtgtagtttgcataaattaaccaagtgattgattgactggctggttggattggttggatacttggctggacttcaactgactgctctcccacatccgcttcagccacttggagcgcccagccacagtagtctcttcccaattccactctccacaaggctattacttgtttctcagcttatctctctaactaaatactgagctcctcaaaaggcaggggcagcttcctctctatcttccaccttcagcacagtgatgagcatcagactccacatagtgtgagaaatcagtcaatggtgtggcaacttacaagctgccctttgacataattggaatctgtgatgtttcttaatccccacagatttcatcatgcctagagggacctattaaaaaatgttagttaattcttcccgtagaggagccacacaggctcccatccccatactgcttccctctcagatggcttttttcactctgttctcctcttgagcctctccctcttctaattccacatgtcacgacttccaccaagcattccctgacaatatgacaggtatttctctcttctgacttccgctgttacttgcccccaacatttgggcttttaattaccaactactggcttgctctatatttatcagtattattgcgtttcactcgcctcaaagattatgaagccctttgagatttggaccagtatatttgttaagctaattccagttggctttcttgtgaataattaacaagtcataactatcagttgtccagtgttctacactttatttcactcaattggtataagtgcagttctaattcttatacctacaccatattaaaaaaaaactgaggtatagaggagctaaggaatctgcttatgatacaactagtaaatctcccttgtacccttcttaatggaagtggggtatctttctgttcagtcgcatatcctaacaaaaactcttcagttttcctgcaagaaaactgcaaccctttctccagcattattgttaaggaagatgactgttaacacagaatccacaattttaatgcaaactcatggctacccaatctgtatcctcaactaggtggaaggaatcctttgtatttgatggcctgcctggagcacctatatattgcccaaatactcaaaactttaatgcccattttgcaaggaagagcagcagatccccaccctgggatccccatagtattggccctaataggattgcttgtattgagttgctactttgaaagttgccatttggtttggtcaatcatagagccaaatgtggggtttgaccatgggtccatggctaggagattgtaaggacactgcttgttacgccgcacagagtgcccttcattatgattctggggagagagccctgtctggttttagtactaaggacagacttttcccagagcaattgttctgtcttttcttctggatcctacggcattttcaactaaccaggtttttctttttggttagagctaaatttatgacctatcctaagcaagtaaacaggttttatagtcatcttaatcttgctcctggttctatttaatgacccacatttacctttccttttaattttctcctgcttttaatttaaaatagacaaacagaaggataagagccagagagacagaatattgcttacccctcagcttctctcagtgcctttgctcaaccccacacttcctcccacataatcagctcaaaaaactgatttaagaaaatcattttacatgatggtgaaatggtttttaaccaatgtttgaatcatagatccctttgctaagggtatagatcttctcactaggaaaaaaatatacaaccctatcaaaaatatttcaggaactcatggatctctgaggctgaagccatgtctatggattccagagaacaaacccttgcttgggtgcatacacaaggcttctggtatccccaatttgcctcccaggacttgctccaagcccagaagacttgggggaattttccaagctactgtcaccaaggaagagcccaggtctctcacctgtctgagcctctccctcccccaacctcacttctttcctccctgaccaaagactgtgacatgctggtccctcttgctctgttcttgcccccactttatgccacaacttacctggcattctggacactcatctgcttcctttctctcaaagtattaccatcctgctgcatccatcagcccaggctgcaaaccccaaagttttgctgtctcacaatttcaaaggaggatagagggagcaaggagtgggggctactaggaccttttaaattagaggacaaagaggttaaaggagaagcctgcagaaccacaaacaatagcggagatatctcagccctgcagaacacaggatcacaaggagtcatagctagtcagatgctgaattccagacatgtgcatgcacgtgcatgcgcatccgtgtgtgtgtgtgtgtgtgtgtgtgtgtgtgtttagttacactatatatagtgtcaggaaaaaactgccaacttggatgcttttaatatgtacctcagaattaatgaagaaaaagtgaaaacatggtttgactatgtaaaagaaatgccaattacagttacatatgaaatacatgtatcatttttgactattaattcgtatggcagtatacatatctaccactaatttttattataaattgcacttgatttgcatactgaatgttgttttctgtcagttgagcctcaaaatttgctgctcacaatttccaacattaaaggagacgttgacaggaatcatagcttatactccttttgtttttcccttagcatctaaataacatagcaagatatgcctggaaattgataatctagctgtggagaccagagtttgtacacatacctgaagccactgaagaaaaatataagacaatacgtaagaaagttacagtacacatgatttatagaaaaatacgagaggagaggatgggccaaagtaagaaaacaacatgaagaaaatgagctttgaacttacccttaaagaaaatatagcatataaatttggtgaaaggacattccagtccaggcagaaaaattgttttctctgacacacaagatatttaagatctaaagaactgtttatttcatattagtgtgctcattacattataataagcttcgagtgaactcacataaagaacttaaaaagattattttttaaatttatttacctacaagtatattcttgtcagttaaaagaaagagaaaataaaaaattcagaagacagaaagctacctataaaactttaataaaaataatccattgtaaaaatggaaaaataaaatctccaccagtgaatgacatacaaaactttatattatctgctaaaatggagtggtaggtatttctttatcttcttggtttgaacctaatagaacaatggctgtatttgaccaactaacaactagaaataatgacagtggatagtgaattcatttaatcatggtaaccatagccaaacttattataacatataaagtgaaatgcctgaaagacaaagttaaagctaaagactttgggaaacctccaaaataggtaggaggtcaaagagagccctcaccccacagttgtctctgaggcttagcaaacttagtgcactgcaatctgaaatcagagggacccattatggaggctgggtatattggcccacttcctctaaaaagtaaaggttaatacaggattaaacatgaaagtagtttagtaggtgttatgggatgcactaaacattcatatgttgaagttccaacctccagtagctcagaatgtggctgtatttagtgacaaggtctttagaaaggttaaaggactaataagttaaaatgcagtcattatgacgggcccagtccaataggactggtgttcttataagaacaggaaattgggacacagacacagagagaagaccaaccgaagacacagggagaaaagaaccatctaaaagccagagagggaggcctcagaaaaaagcaaccctgccaacgccttgatctcaggcttttaacatccagaattttgggaaaacgaatttctgttccttaagccactgagtctgtggtatttgttgtggtagtcccagcagactaatttatttgggggaaactccttggggaggaaatgaggagggagcctgtggagggtgggaaaactgtgagtccacaatgctggtctggtctgctcttgagtgagaaggggaaggggaaggagaaggggaaggggaagggcaagagaggggaaggggaagggcaagagaggggaaggggaagggcaagagaggggaaggggaagagcaagagaggggaaggggaaggacaagagaggggaaggagaagggtaagagaggggaaggggaagggcaagagatgggagtgggaaggggaagtggaagggagaagaaggggaagggagaggaaggggacggggaagggagggggaaggcgagggggaagggagggggaaggcgagggggaaggtgagggggaaggtgaaggggaagggagggggaaggggaagggaggggaggggatggggaaggggtatggaggggaaaggggaaggggaagggaggggagggtgaggagggaggggagggtgaggagggaggggagggtgaggagggtggggaggagggaagaaggggagatgggtgggggaggagggaggggaggagggaagaaggggagatgggtgggggaggagggatactatagtccaggtctaaggcaagttttgcaagactatagaggagtcctgtatctccaggaatgggctgctttagtctccctgccatgctgagtcagcaaccaagaacagttcacgggcagcattggtgatgggtttcagagcagagctgttgggtttgtcagtttattacattccaatacctgagaggcacattctcatggccaccacactggaagacctccatcactgtggacagtgcccagcaaggactttacactcagatgccacaaatgcccatccaaatttccactgaatgaaccacgtttcctattcagttaccgatgtgaaactacagaatcatctcattttctctcaaggacaaatatttcatgctctacaagagtaaaaccagtgtagccaaaccccactgactgaagaattatagctacataaaagataactgtcctgcaagttacttctgtattccttgtgaaaaaaaaaaaaaagagactggctacccaaattaataatgtaaataaggacagtgatggccccactgaggcttgtccaaagcaaggcccagtttactaaccccggaatgggaagatcaaacctggtgttgggagtttggtcccaagttaccacacaaactcattctgcttctcacctttcaagcctaccttctttcctttggatggggaatcaaaatgcctctttcttaaagctacgagctgtctaatatgctacatgaggaagagaatgggaaaaacaaacagtacatgaatagaaaaatgtgctggatttaaagcaaaaagatataactaatctgacatgtaagtccaatccttgcatctccaatatgtagcatagtggttgatagcaggtgttcaattcatgtttgagaaataaataatggcaaacgcattgaattagagttttatagtgattaataataaatgaaagtagttcctttaaatgatagtaattagcatgtctgtggtcaggcaaggagggggtaaattacccagagcataaagttgcagtgaggctcttcttaagttctctgaatcaagggccagtcccaaaagcaggggaacaaaatggggcatagacagtggactgggatcagcaggtttcagggcaggtttgcatctgtaggagagaggaggctgaggtgttccattttacttcctttacaatgccggtgcagggtaacgtttaggcagggaaggctgaaatatatgacatatgggctcccacaaatcatcatcacctcaactcaaaatttatcagtgtcttccttgtacttataaaatagaagtttccattcactcattaattaattcattcatttagagccaatgatcagacgctatgctatttggggaaacacaaattaacaaaatgtattctctaccatttaagaggaagacaaatgtaccaacaggcaattatagtacaatgtatgagatatgctgacagagattatgttctatgaacaaaagttctctacaggaatatggaggaaacagactttattccagtgaacagtttggaaatcagagagacacagcctgctgtgtaaaatgaagctatgttccggagaacaatgagagtgttctgttttatagcaaaacctcctacccaggtttccagtcaggttggtttatgcaaatgaacgatggaaactagcttagtgctggttggctggcacagctgagttttgattgatcaatacagcttagccctgcttggttgatacagctgagccctgtttcatccagtcgagtcgagggagctctgattggttgagctctgattgagctctgtttggtttccaaacccaaaaccaggagtcttggctgatgtttctttctggtgagaggaggggggattgggcctccgttcatcttggcactaacaataggaactggtttagcttgattgtagaaagagaggtcctgtgatacttttacatctttctgagaacacaattaccattccttcccccagctaggaccacctggttctgttttaactttgagagcctcagcctcaaagattccattttcagtctgccaggggaatactttagagttcaaagggcctccagagcagagacaggggaaaatacctgtctgcagggtaagtaacaggattgcaacaggttggcatttgaactgggccaagtagagcaccagagagaaaggaaatgggttatatatctagacagaagagcaaagaaatggcaggtgccaaggcacagaggggtcatggttttgattaagatgaagtggggaggtgcaatcggtgataaggttttaggaagaaacggaaaaagaattttaaagataaaaccctttgcagattgacaaacctgacaaaaacaagaaatggggaaacaattccctatttaacaaatggtgctgggaaaactggctagccatatgtagaaagctgaaactggatcccttccttacaccttatacaaaaattaattcaagatggataaaagacttaaatgttacacctaaaaccataaaaaccctagaagaaaacctaggcaattccattcaggacataggcatgggcaaggacttcatgtctaaaacaccaaaagcaatggcaacaaaagccaaaattgacaaatgagatctaattaaactaaagcacttctgcacagcaaaagaaaccaccatcagagtgaacaggcaacctacagaatgggagaaactttttgcaatctactcatctgacaaagggctaatatccagaatctacaaagaactcaaacaaatttacaagaaaaaaacaaacaaccccatcaaaaaatgggtgaaggatatgaacagacacttctcaaaagaagacatttatgtagccaaaagacacatgaaaaaaggctcaatcatcactggccatcagataaatgcaaatcaaaaccacaatgagataccatctcacaccagttggaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttaacccagcaatcccattactgggtatatacccaaaggattataaatcatgctgctctaaagacacatgcacatgtatgtttattgtggcactattcacaatagcaaagacttggaacctagccaaatgtccaacaatgatagactggattaagaaaatgtggcacatatacactatggaatactatgcagccataaaaaaggatgagttcatgtcctttgtagggacatggatgaagctggaaaccatcattctcagcaaactatcacaagaacaaaaaaccaaacaccacatgttctcactcataggtgggaactgaacaatgagaacacatggattcaggaaggggaacatcacacacggggcctgttgtagggtgtggggagcggggagggatagcattaggagatatacctaatgttaaatgatgagttaatgggtgcagcacaccaacatggcacatgtatacatatgtaacaaacctgcacgttgtgcacatgtaccctaaaacttaaagtataataaaaaaaataaaataaaaaataaaaaaccctttgcggataggtggctctggagtcacctgcaggagatgctgggtagccaagggcatggtaaggcaatggacttctgaaagaacaatgaccaagaggtttctagagattagggggacaggagtcctaaagggggagctggagaataccaaagacaaacttgatttgttttacccttttcacacaagttacatatttttaaaacctcttcttaggacctaattttctcaagtcttgcttaatcccttgctcagaagggagaggtgaacagaggaaggggttcccccagcagcactgagctggctctctgatgaagtgggggcacctgtggaggggaagctcagagctcaccagatactgccaacagcagctgcacaggagggtatctgagaggaagctactgttcccagaataattaactctcttcagaaatcatgggcacagacacacaccctctctctgaagcagaaccaagctcaagggctggagatttcctgttccccaccatcaggtggacagcccactctccctactccacctgcctacagacaaggaagatcaatctgggtggctaacacaccttgccctagagtaaccaagattagaaagatgcatctacttttccacatgggacatgaaattgagtctatttaaaagttctggcacaatttagatattaaaattaattaaaataaatctgttactagcaatctacctaaattatgcatacaatgtttctcagtaggtactcttttgaactaccgtttagctaaaaaaaaaatcaatcaccaaggaatttaagtaccaaagtttggcttgaaacttcaaatccctccatgtcaagcaggaaagcagagctaatttagagggactgtccagccagggatggtgtcaggcaggctgagggcaatataatgattttgcagggaggtaattaaatgggacataacagcaattatagcagcaacggctaacatacactgaccacttccagtgggtcaggcaacaacatgctaagtgctttaagtgtattattttcttcaatctttttctttagtacacaaaaaaagtacaaaggaaaatatagcaaaacctacatatccaccacccaaaatttaaaaatgacattttgtcatatttgcttcagatttttttattttaaaaaagttgcaaatgaatttatactcccaaatcccatttccctctctgtttctcctcagaaacagccactatgtcatgaatgtggttcatattcagtgacattttcatattttaccatatttatatgtgcctataaatattatagagtattattttaggtttttatttcctgaaatcttttatcaactcaaatgcatgacttcaaagtctatcactgtggattaatttgttccattgcacttatcaactttgaacatactgtcagggaagaattttattttctgttttattaaataatgtataaatagtgtggcatattcatattctttgcccctgttttctatttcattatctggagttttttttttttcagtaatttgtaggagtctttgatctatcatatatcccaatatcttccaccaggatgtggtctagctttacctttgttttcggtcttcagtcattcaagagatgcctaactccaggcagtctaatccgttattttttccttacctgatatcataaaaatatccttttgtatctatatctacctatctatcctgtaactgtattctacatacagtcataaagtctcctttttttgcatttggtctctaatccatcttcaatttatttttttaaatggtgtagagacttaattatattttcatcaaccacaacaaaaaaatagattccattctttcttcactaattggcaatcccacctccaccatatacccagatcccacacgtgcataacttctcaagctacctcttctgttctctctatttgtctatccctgtgctaactccaaagccccatgtcatgtactgaagcttttttacaaatcaatatataggcaagtctttgttttttgcctgtttgcttgggtttcacaattgtctggctactctttcaattttatatttccatatgaattatagaatctgtcaaatctctcacacatacacaccacaaccagttgatatttaattggaatttcacaaaatgttttaattgattgtgactagacagcttttcaatacagaaacatcccacatatctaaataagcatagtattatctctctaatcatttcagacttttctctcaataacgtttatattttctattttttcctaagtaacatatagttttagttgatgttatgaaaagcattttttcaggtgggcggatcatgaggtcaggagatcgagaccatcctggctaacacggtgaaaccccgtctctactaaaaatacaaaaaaattagccaggcgtggtggtgggcgcctgtagtcccagctactcagaaggctgaggcaggagaatggcgtgaacccgggaggcggagcttgcagtgagccgaggtcgcaccactgcactccagcctgggcaacagagcgagactctgtctcaaaaaaaataaaaaataaaaaaaaaagaaaatcattttttctgttacatttttaatgagctagttctggtacagaagacagagttacttactagcaaatgtcactgtgggcaagctctttatctcgctgtgcctcagttttctcaaatttcaaatgggaataatagtgctacctaataaagttactgctggtgagagataaataagttaacacatgcctagtgcctggcacatagtaattaaatgcaaatgttagcttttattattaaaagaatattaatttgcatattgattttatatctaacggccttgaaaatttatgaattatcttgaattttcttttaaataatgatatactctgagtatgaacaaatttactttcttctttcttcttccttataaacatttctctttcttgccctattgtattacccaggactaacaatatcatgataaatggaaaaagaaatagcaacgttcctgtcttactctctttaaaagacatattctaaaattttcacctttactatttatgtttgctgtcatttttcgctaactataatactatttatcaggttaaggaaggccccttgcattcctagtttggtgtgcgatttcatcatgaataggtcttgacgaaggcatttgattttctctaatttaatccctacattgtagtctacactgaacatttagcaacaatatacattgggccaggggtcagcaaactacagcctacgcaacctgtttttgctgttaaaaattttttttaaaaagtttattggaaaacagccacacccatctgataacatattacccatggctgcttttaagccacagtgacatagttgagtagttgatacagaaaccatatggcccacaaagcctaaaatattgaccatttgaccccttacagaaaaaaactgctcaccctgatatacagcatattaaactgctcttgttacaactttcactctaaattgaggggttagtgaataagcaggaaaggaggccaaagagttttaagttttttttttctaacttctcctaatctctgttccttctaccttctttcatgtttacatttctctctttcctcttctctcttcttccccctttctttttccccttctcctttttttccccttgccattctacacttttaaaaagcaatgcagtccagatgcagtggctcatgcctataatccagcactttaggaggctgaggcaggagtatcagattgagcccaggagtctgagaccagcctgaacaacatagtgaaatctcatctctacaaaaaacagaaacacttagccaggcatggtgattcatacctatagtgccagctactggagcagctgaggtaggagaatcacatgagaaccagaggttgaggttaaggctgtagtgagcagtgatcacaccactacacatagcctgggtgacaaaatgagaccctgtttcaaaaaataaaaaataaaaaagcaatgcaaaatatcttcctttgattaaataaacaataaaactgtccaacatttttttcaatatgtagtgataaccaatatatagctaggtgctttactaagttactttaaaattcatttgctcaacaaacatctattgaatgctatttgcaaggcactgttctaggtgtctgaaatataacagtgaacaaacaatgattcctgcccttgggaagcttacattctaattgagggaaatgaacaataaaaatagagcaaatagtaagtgatgaaaaaaggaacacacagaaaatggtaagcgggaaggggaggggaaagaactacagttgtgtaaaggatattcagcaggcctctttgcaaaggtgccatctaaacaaagatttcaatgagagcatgaacccccaagcccatggcaggagcattcctggtgtgtccaggcaatggcagggagattgggatagctgggacagatgaagcagagagaataggaggtgagatcagagaggttatggagaccagattgcagaggccctggtgggctttactctgaccaaaatgagaagccactgaaagattttaaacagaggaataaggtggtctggcagatttttaaaggcttacctttggccattgtggtgagtacagtttatagaaactgcaaagccattcaagaggccatggcagtattgagaagaattcacgtcatttaatctctcagcagttggataagatatatactatgcccttcttccagatgcagaaagtaagatgtggaagtttaaataacttgccaagtcacacagctaatataaagcagagctggttttaaacctagagtccatccaaggtcaaaggttggtatctgaagttagactagtttggatttcaccttgtgaaaatgcttcataaactatttaatgtatgatattataattaagagtttcatgattttagactaatcatgtatattttatattttatgaatttttagataaatcatacttctaaaataaaaaactagttggatgctatagttccagactcctggattttgttcttgaatggcttatggataaaagcccctaagttttcacgtattagatttgcttcaaataaacctatagacttgggaatttatttactctagccctaggaactagaggctcgccattatattcttattctcccatagagtttcaaattatattctttaaaagacacttcatgactggagtgttgaatcttcttttttaagcctgctgactgataggtagattccatgttcaaatctcatcttgcacactgtaaatatcttccatcataattttagtaggtctagaaaaatcatctctctctctgttaaacatacacatacacacacacacagaggagcaacattactggcaagaatgataatatatatggaaggatttactaatgaaatatttctgtatattcttcagtgacaaactgggtggctttatgttaaacaacataaaagaaagtcatacaaatttgatctccagtttattcgtgttgagtttgtaaaccatgcacactgacgcaggtttacaagtaaatgatgttgagaaattcaaacacatacatatgtgtgtgcaatccatatgtggaaatgcagtcaataatttatatcaaccagccacaaatatttattgcaattattaaatggctcctaggcacaatcttaggtcttggggattcagtgctaagaataaatgggcaaggattcccatcctcattaagcttatagcctagtagggaaaccaaacaataaatacttagaagtattaggagagccatgagaaggagggaagatgtagagctgttcttaacatgggagcaaagccaggccagcatggtggagggacgatggtcacagaagacagccccatggaagtgatgcttaagctccacttgaaggacgggtacaggttatcaaggagaagagcaaagcagtgagggaggaaagaacttctcaaggaaagagaagggcttgtgcttgatagaggagaatccaatgccttaggagaaagaagaagtgggggagtctggtgtgcgtggtggaaagcagcacaaggtgggtgccacataaagtgatgctggagacaggcaagggccaggtcaggtagggctgaaagatatggatttaactttgaggacaatgagatgccacttaggaaggatttttagcagtagaatggcatatttagctcttattttttaaaggtcagtctggccactatgtgaagaatggactggaagggaacaagaatggagcacatttagaaggccattgcaatcacccagatgagaagtgcagtgatctggacagaagcagagacagggtagatgaaggtgaacagtttcaagtcaacagggactgactgtgcgtgggggatgtgtgaacagcaggagctgataaggagccctcattttcggacagggagggtaccaagaccattcagaagactggaaccatggaggaaatgctacttcacaccaggtacgaatccatttcaagtgtgttttagaggtagaggtaggagtgaaggtccattccagcaccaattctccctaccaacctgaattgtttattgcaaaagattttatttcattggtctctttttactgaaggtataaatggagtgtcatcttttcaaggagagagaaacagatgccctttgagaaggggagacggaaggggaaggaaagttctgaaggcagaggtgtccagagaagccgaagcatgcaatgggaggcacaggagtgagagtgaacttcaatagacacacactgacccaaaagagttgtgcatcaaagacacattctgataactctgcaacttttgcagagagccgatgacgttctaattgtaacatttccctttttactttttcttccttggtgaatggtggtagacctattgattacaccataaagataagagggaaaagaaggaatgactgcttttctcatataattatctttttaaagtccttgtcctggtttgcacactcaaaaaggaacacagaatttgcaattatagggaagttatttctgagcataattaaatgctctccatctttctctcacacaaaagcttgcaaattccaagctagtagatttttgaatcctatcaatcatttctatttttaaattatattccagatttattatatgatatactaattataatacaatatttgcaataatgaaaatgtatttgaatagtcaattggaacccacaagtcaactcctagatagatgccttagtggctctgaaaggtggtccccacttgggatttgttaaaatgcaaacacctgggccccactctgggtgtacagaatcagaaattcagggagtgaaactcaacagtctttttaataagccctccagttgattctgatacatgttaagattgagaaccacttcttcagcagtgtttcccaaccttttcccttcgtggcaaaaaaaaaacctgcacacgtaccctgaacctaaaataaaagtttaaacaaaagagaaaatgatggcatttgtacaataccccatgttaagtggataaggctgccagaggcttgccccagaccctatttgtgttggcctgagcagctcaccgtaaccttttcatgatccaccagcagaaaaactcagatctgaagaaactcacaccagtgcaaaaacaactatatatacattctttttgttaattatggcaccatttccaacaatgaaaaattatccaaatacaaattaacaaattgtgacatatttgtgcatagaaatactactcacagttacaatgaataaactggagttccatgtatcaacacagagaaatctcaaaaacataatgttgagcaaaaaaaaaaaaaaaaaaaaaaaaaagcaggttataaaacaatgcatacattttgataacatttatatagtatttataacatgctgaacaatactgaatattgtttgtggcatgcccacatgtagtaaaatcataaaggcatgcataagaatgatacatagcccttaggaaagaggaagaaggggaatcagggatgtgtattcatggggctttacccattttatttcttcaaatatctaaagaaaatatagcaattggttaagatgtgacctggggagaaagggaatagttacacatgggtttcttatatgacttgatgtatttttctgtatagttaaaatgtttcatgaaaatttttgataagaaaaaaaaatcagttggagtctgctatcaatttatccgagttgtaaacccaattttgtgttagctctttggtgttgggcagattactttctctctctgggccttcatttcccatttgcaaaatagaaggggctgagttcagtgacctctgaagctctctgcctcttgcaccctcttcaatatatattggtgctcaaatagaaatactcttagccccttctctttatcccctctatgcataggcaacaaccttctcagtagttgttccctgtccagctgtctaccttaatagccccttgtttacaatggccccagcaaatgggctggggactaataacacatcacaaagcaggaattgtagaacctgtgtttgaagatatattttaagacaaagagaataaaaataaaaccagaaaagtttggtacatagacaagcagtgtaggatttagaaaatgaccttgaatttgcaagcaacctttccttgaaggagaatcttttccctgagcaatgaatttcactaagtgaaagagaatttcaaatcaacattacagcaatgttcactactttattcctactctttaggcatcacctctatctccttatcgctcaccccaacattagatatgattcaatacaactaactagctttttcaatgaaagaaagcttagtttctcatgtttaggaactgattcctttgatcttccctcaagttacgacttacataggcaattccctttccaaataggctagtttgtagattctgtctttgaatgtgctcagtcatttcaacaatattaacatcataatattgatgaactatgcctacaaagggcgactgattttgactaatttattatttactacaaaatatttccaatgtacaaaaaatatactcaccatcaatatgtatttttaagttttactaatttgcacactcaaatcagcagaccaagttaaaatggcatcttctaccttgtgatttgtgacaccatatcacaagcttgagggttccatgctcctttttaggcacttggtgagtgtgatatggtaggaaacatatttaatgtatggttttagctctaaaattcactgactaagtggttttaggaaatcattcaacatctcttggcttcagtttcctaatctatgatatagacaaaatggactttgttatttacaaggtctccccatctttgaaaccccttggttctatggaatgacctaacaaatccattgatctggcattgtggccagtctcagtctaagttttgaactcttttggttgagaaatgataaactcattaatgagatgcaagctagattcaatgcagtgtgtatatgtgtgtgtttatacttacttatattgattatatacatatatgtgtatttcatttaacagaaggggctggatgcagtggctcatgcctgtaatcccggcactttgggaggccgtggcaggcggatcacaaggtcaggagttcaagaccagcctgaccaacatggagaaaccccgtctctcctaaaaatacaaaaattagctaggcgtagtggcgggtgcctgtagttccagctactcaggaggctgaggcaggagaatcacttgaacctgggaggcagaggttgcagtgagctaagaccacaccattacactctaacctgagtgacagagcgagactctgtctcaaaaaaaaaaaggggggggggaatatacatttcatcttggttattatacaaaaaattcccaatatctggcacataacagcatacagttaatacttactgaattaacaggattcattttaagttcatactatttgatatactatgctagtgacattaaatgacaatttctcttttaatccttacagtaactctgagaggtagatacttcttaactggtataggtttacagtactactaaatacgagtcaggattctaagtctgacttggcccatctcagtgataatattaatacccaaaagatagacatatgctttgtaaattaattttataagagcttcacccttgtatatctaattacttctaacaggcattcaacattgacctacaactttatatttcttccttagtactcccctgaaatttcttactattcactgttatgatgtgcctcgctgctgattaaaaaactaactcaaaactaaaataatgagggcccaaaatgagaattacttagtgggatccatccagaccttattcttatttaaataaatacagttgactttactacctgtgaatgactgactttggaaattatttgtggtacctattttatcccactaaactgcttaatatatcatattatgtacatcaacctcataactttctttgagggggttattagtctgtttggttataaaatgcagtcaataatatgcattgcattacagcaaaacatctgacagaaaacagaaaacaacatacccaaacagaaaagatggaaaaatgtagactggatgttagcgcaactagtaactcgttgaacatttgtacccaaaaggctagtgaataagagaagaacctcaacctggaaaaagaattgagccacaggattctgttctggacctctttctgttctcaaatattatcaatggcttagatagaaaacaaggtcctaaaaatgttaagacaaaaacactgagtgggataataaataggttgtataaaccaaaatagatatggtagtgtacagatatgggtcaagttgaacaaatcaaaatttaacagagataatcataagatcaaaaataataattctcaagtgcagaatgctaaaaaaaaaaaatagttggcagctacctagacagaaacatagaaactttggttggcaataaattcaatatgaaccaaccatatggtatgactacccataagctataccacctttaggtacaataatagaaacaagaaatttctgtaataatagaaataaaattttctcagagaggtgagattataggcctgctctccttgccaaagataacttaattccatgctgcagatggattttggtgttgaaccttaaagaaacagacaaactggatattcaatttcttataccagaagaagggaacatttttttaaatgatgtttttcgtctacagaaaagaaaactaaagaaggacatggcatctatctttaaatattttttaggtagtctatggaatgaaaatagtcttcatctgaaggatccaaagaggtcaaatgagaattaatacgctcaaataaaggagattgtgacttggcacaataaagaaatatatggtatggacttatcagaatgtgagttctcccatgttgggtagagggacaaaaggctgaacaaccaattagtagaatattgtatagggaattaagtcactagtgggagctttgtctgaatgaattttgaggtctcttgcaaacctgaaagaaaataaatccataatctacaaatggcctaaaagaaaggtgattgcaaaagacttattcacattactaacggtctcagcaagatatggtgtgaagtccaatctgctacccatccccaaatatttatatatacacacacacacactcacataacacacatatgcttcttatcaaggtggaaaaaacaccaaagccctcattagctcagattctactgtttcaaatgtgtaacaatgcagaagaaaataggatcaaggtttgctatctctaaggggaaaaaaaaaagtttgcgaagtgaattgctagggtaaacaagattctgggaggaagcttgaccttacaaccaaagtcaaaaaaacacaccattaaaaataaatagcttatgatttctgtacaaataaatcttcccaatttctcaatgacccattctttaactcagctcaggtatgactgaacagttataagtccttgctagcagtccttactgaatactacacacacttgaaaataataaagttattaaaattttgtttaattcagctttcctttgaactaggcattccccaagtttaaattaggtttcattaatttaagttatttcaggaaatttttgatgatatgttgctctacattattcttgagtacagataagcaagaaatggccatagatcattcccagccaacacaaagtaattattatctagaaagagataaaagtaatattataagtaaactattacctagaaagagataaaagtaagtaagtagtccaaaactaaccttaaagaagcaggagatcacacaaacaggccataaactgtagaagcacattaaatccaaagctgccaaattcatgacatgcctggcaggtctgcatgggtgcacaacctgagcagctgcccagggcctgtacacagaagggaggtacacttagctaatgatctactgtcaatgtcttaaaagtgtcaataatttttgaacactgggccccacagattatgcaggtggtcctggagactggcacataatggtgactgagatatgaaaagcaagcaagtaaaatgtatacacaccggcaaaatctaaaaatagctccatttattaatgaaaaacaatatcctgtaatcaagacacagcctgttggttaacgttataaagaattactttgcttgtttaatgtgtaaaccaatgataattcacaaatttgctaattgtttttctgtagatgtgagctgtcaaccggtggagcttaagtattcaaaagtaatcaaccaccatttcaaattccatcaaaaagtcatgtatcactttcaggagacatgaaattttggtacatttttactggagttgcagaaggagtgataaagcaaaagtgaattttaaaacaacaaagcaatctcctcacttcaccacagaaaattaaatgtagtgaagcagctttgtgacacttcagacttttccagtattctctggattgtgaactgacaaagctacatatgagtgaaaaaaaaaatttgaacttttgctcaaattatattcaccctaatgtggattgtaaagttcctttcaccagtgagaaacatacagctttatatccacgtttacagaagagaaagagttaccaaaactttaaatatcaaaaatatttttatgccactgtcttatatacttcagcataactcatttctaaacatgtaaatctagaaatgaagcaatcagagggaaaagttaagatgaagaatcaaacatcaaatccatcttggttctagtctaacaaatgtttccccactggatttcaagttcatgagtagagtctatgtagctctggagaaggtatttaatagtaacctagatttatataacaacatttgttccaaacaacatttgcatacatcatatagtttgtccatacaatatccctataaaaacaagaaaaaaaaagcatcctcatcattttaaagatggtagaactgaggcacaaaacatataaaggtttttccaagatttcacacatatacaaagtaaaacatatttgaaaatcatttctcctttttaacatatctctattattaaaatctgagtgcaagattattgttataaaatgtatgcccagaaaagatattagttacaatgtaatttcaattataaatcattttacctggcactctatgaggcactaaataatttttaacaaatatgcaaattaaaagattatattttctaaatctcattgtgaaattatgtttaaatttagcaccagctcatatcccacaaaaaaaaaaacctaatatagggaaaacttgtgatagaaacagtctattaaatgaaattatattttgatttctaaagctgccttgcaagaacagaggttacaatttctagaaggagccatatacaaatttaaaaagagccataattcatgcaaagaaacattttctaacctgtaatttatagttcagctgcctttctaaaatctcaagcttttagttaaataattgtagatttgttgctcagtttaaaaacccttctggaatcacgtctttaactggcgttgtgacgtcttacgtcatgatgttgcgtcaccacgtgatgacgctgtgccatcacaacacatcatcgcatattgacacaatgtcatggcataatatcatcaaattaaattcatcagcactccccacagcctggccccaggaagggcaagagagctttaaagtttctctttgttcttgtcaacacactcctggttggtaggcgagaacagcaactggacaaatcatttcctggtctattaaaacttcctagatctcaaattaggagaatttgaaagttacagcttagagttggaggaaatagttttcacggggatagatttcatggcttgttactcaccttgccccataactagttacacttgaatcccattttaaagataaacatttataaatgttagttcctcctttttttcccaggccctaaaataggatcatatttaggctggtgaaaaaaaaaattaatttgtttctaatttcttgccctcaatgtccaccttcctcaaattgttttccttcaccacaacattcctcttctataacattctgaaatagcaagtaatggaggataggaggcagatccagtcaatagttttgactacagacatttatataaggctggagggtgtgttgaaagctgtgagagagggccttttgccatcacaggcttggtgacaagcagagtctccgtgttagcaactatgataaacctgggcatttggatgaaacatttatctgaatgttatctgaattaacttatgaactcttccaaaaatatgtagttaccagttcattaaacataatgggcggtttgtgcagactgtcagtgtgtgacctctctttcattagttcatttgctgtgtgccagacactgttctaggtacaagggctcagatgaaacagaagaaacagtgtcaccttgaggtgctcacagagcaataagggagacaagtgagcaacagatttcaagacaacctgctaagggctctaatgatgatatgacagagtgttctgaggactcagaaaaggaaaggataatctagggttgccaagaagatcctataggggagagaacatatttttgtatcttgaaaaatgaataggcagagaagaaaaaaattccacattcaaatgcaagaattggacaagttggacatgtgggagacaccaaagtattagactaaatccgtcattttgtagatgttttctcaaaatgattggttcatataaattttttttttttgcttttttttttttttgttttttttgagatggagtcttgctctgtcacccaggctggagtgcagtggcgcaatctcagctcactgcaacctccacctcctgggttcaagcgattctcctgcctcagcctcctgagtagctggaattacaggtgcacgccaccacacccagctaatttttgtatttttagtagagaccaggtttcaccctattggtcaggctggtctctaactcctgaccttgtgattgcacccgccttggcctcccaaagtgctgggatgacaggcatgagccaccgcgcccggcccatataaatgatttttaagaggtactgactcacactcatattaccataatccttcatcataattacaaatagcctctagataactcatgaatacgctgcatcaatgcagtggagttttcttgtaggagcattttccatccatgagaccaaatatgttccttctctctttgtaaccaaataaaaactgaaaatcaaagccacttgtactttcttgaaagcatctgactagccataaaaaccttggcaacttctcttctggtgtgtacataaagatggattaggaatatccctgctgctgattcaccttttaaaacaagcactggaaaaacacttcagcccagccaatgataagtggttatatattctgacattaagccccacatgaaagtcactggtagacattttctacagctaccataatcctcaagaggtgtttagaaactagacataacaaaagaataaaaacttgaggggatttcagtcctaaaagacttcatctttctgagaattacatgacatcgaaaggcaagttttcaaacaagtttctaaaatgtcacttttaagctagacaaacacatatctttttagaggttatgagagcaattatttaaacttgataaaatatttaatgtatggctttgaatctttaatgtatggccaaataaatactcatatatgatatatacacatatatattcattaacatatatattttataaaatgatacaaagaagagtactagtacctacactccaaaagacatgcaataagtaataatttggttacagaaagagagaaaaagttttcaaataacaatcctttttcactgatagtttatacaaaattttatcatgaataggatagtaagaaacaagatacaatatgaaatttgcttgaataagtgatatatttagtaaatggaatacagaaaatataggcagaatatctgctgaaaataggaacccaatgatatataacagtccaatatggagttagtgaacttcttaagatttgtttctttaagaattataagtatggcatgccttttttaaattccaaatccagaagataaacaagaatagcaacatgagaaattcctagtttttgcagatttagtcagctgtatattaatgtacttttcatctagatagaatttaagcaacagatgcatgtagcaaaaaaaaaaaatttaactcattttgtgtctttcagagcaaagaatcttttgtagtagaataatcacccatcatttgcctacttagcaagttcagggttccacatatttgctttttcaaatagggacacatttgtgcaaatgtgtccagttatatagtgatagggtggccctgaaagtggggctgaacatgttcatatgaaacttgcctgcctccatgttgcacacctaccttgtatacctgagacaggtataacaaacaactgcacttattctttctgtccccatagcttttcttctacttctttaggactcctaagattcacatgaactgaagcaaaatatccacagagagacattaaactttatttacttacatgaataattttctttaaatcattgaattcacagaaaggaaggggtaaaagtactcctgcttattaaggactatgctagctactagaaattgtgctaggtgatttacatatgttatctcatttcgtgcagttacttatttaatgatcttgaaaaggaatacaattattaactaatacaaactacaacattcagctgtttgaattaatctgatagctcatcatttttaaccaaaaaaatacattaacattttcaagtgtctctatgaactgggcattattattttaaaattaacccaacttattttcccatggttactaggtgaatgggcacagatcaagctaccaatttaatcaataatttctggctttggggcccctgcagcagaatattcatctccacctttatcttcctttcccccacacccttcctccccctgctgatgcttgtggaagctcaagttctactgtgtttccagatcttcctctaccatctggggtgttgactgatatctctctgctatcgttactgatgacaggactttattaatgtcatctcagtgtctatcttgtcactgctcaattcaggcctgcagatgctaaagttgggaaggatacttttcccaccagaatgtaaatagtctactgtacttccatactggatgttctttatttttcacactataggagagccccagactgattaattaaagaatcctaaatttaagttaaagttggtgaatctcaattttcaaagcagcttcttgacctccttgatgctggatcatccaaaatttcctacagaagaaaggctgccaggcgtggtgatgtgtgcctgtaatcccggctactcaggaggctgaggcaggagaattgcttgaacccaggaggcagaggttgcagtgagccgatatcgtgccactgcactccagcctgggcaacagagcaagactccatcaaaaaaaaaaaaaaaggagagagaaagaaagaaaagaagacgaaaggctaattccaggtaattcagacaaagagatcatgtggggaaaaggcagatagctaagctggtgaagccaggtgtgcaggaggatcccagcaaatctggggaaacaaacatgactaaaaaggatacaccaagagaggagctggcttgacacagcatgcaatagggagtcattgccatttataaaagaaggaatggtgtaataaaagcagcactgtagaaggattcaggaggaattggaggaattccaggagtcagggccaccatgacactgcaagcatgaaagctggggttcagctggtgtcaggggacatgggggtgtaagagtccaaccagagatgttttcagcaaaataaatgtcaggacttgtgaacacattgtatataagaaatactgtaggaatggttggtacttttctttatatatctggtagaatttgacagtgaatccatcaggtcctgggctttttttggttggtaggctatttattagattcaattttagagctggcttttggtctgttcagggaatcattttattcctagatcagtcttgggagggtgtaattgtccagaaatttatccactgcttctaggttttgcagtttgtgtgtgtagaggtgttcacagtagtttctgatggttgcttttatatctgtgggggtcagcagtaatattcccttcatcatttccaattatgcttatttggatctcctttcttatcttctttattactctagctagtggcctatctattttattaatttttttcccacaaaaccgactcctgctgggtgtggtggctcacacctgtaatcccagcactttgggaggctgaggcagatggatcacaaagtcaggagatcaagaccatgctggctaacacggtgaaaccccgtttctacaaaaacatacaaaaaattagccagacatggtggcaggcacctgtagtcctggctactcaggaggctgaggcaggagaatggcgtgaacccaggaggcagagcttgcagtgagccgagatcacgccactgcactccagcccggatgacagagtgagactccatcaaaaacaaacaaacaaacaaacaaaaaagcaactcctaagccaggccaggtgccatggctcatgcctgtaatcccagcacttagggaggccaaggtgggcaaatcacttgaggtcaggagtttgagagcagcccagccaacatggtaaaaccctgtctctactaaaaatacaaaaattagccacttgtggtggcaggcacctgtaattccagctacatgggaggctgaggcaataggatcacttcaaccagggaggcggaggttgtagtgagcagagattgcaccactgcactccaacctgggtgacacagtaagactctgtctcaaaaacaaacaaaaagaaaaaataaataaataaactcatggtttctcatgtctccattttcttcagttcagctctgatttttgttatttctcatcttctgctagctttggggtggatttattctttctctaattcttgcagttgtgaaattaagtttttaatttgagatctttttgacatgggcatttagtgctatgaatttccctcttaaaactaccttagctgtgtcccagagattccagtatgttgtttgttctcattattttcaaagaacttcttaatttctgccttaatttcactatttacccaaaagtcattcaggagcatgttgtttaatttccatttaattggatggctttgagtgattttcaaagtcttgactttctatttttattgtgctattgtctgagagtgtgtttggtattatttcagttcctttacatttgttgaggattattttatgtccaattatgtggttgattttagagtatgtgccatttggcaatgagaagaatgtatattctattgttttaggtggaaagttctgtgaaggtctataatatccatttggtccaatgttgagtttaggtcttgaatatctttgttaattttctgccttgatgaactctctaatactgtcagtaaaatgttgaagtttttcactattattgcacagaagtctatgtctctgtgggtctctaagaacttgcttcatgaatctgggtgttcctgtgttgagtgtatatatacttaggttaggtctttttgttgaattgaaccctttaccattttgtaatgcccttctttgcctttttttattcttcgttggtttgaaatctgttttgtttgaaattgggattacaactcctgcttttttctgttttctatttgcttggtagattttcctccatctctttattttgagcctatgagtgtcattacacatgagatgagtttcttgaagacagcataccattggatcttgcttttctatccagcttgccactctgtcccttttaagtggggtatttagctattcaaggttagtgtctgacaaaggtctaatatcccacatctataaggaacttaaacaaatttataagagaaaaccccattgaaaagtgggcaaaggacatgaacagacacttctcaaaagaagacataaatgtggccaacaaggatatgaaaaaaagctcaatatcaccgatcattagagaattactaatcaaaaccacagtgagataccatctcataccggtcagaatggctattaataaaaagtcaaaaaacaacaggctggcaagcttgcagaggaaagggaacacctatacactgttggtgggagtgcaaattagttcaaccattgtgggaagcagtatggcaattcctcaaagagctaaaagcagaactaccattctaaccagcaatcccattactgggtatacacccagaggaatataaatcattctactataaagacacatgcatataataaatttcattgcagcactattcataataccaaagatgtggaatcaatctaaatgtccatcaatgacagattgaataaaggaaatgtagtaccatatataccatggaatattatgcagccataaaaaagaaccagatcatgttttttgcgggaacatgcaatagctggaggccattatccttaggcaaactgatgaaggaatggaaaaccaaataccacatgttctcacttataagtggaagctaaataagaatttatgaacacaaagaagggaacaacacacactagaggctacttgaggtgagagagtgggaggagggacagatgcagaaaatataactactgggtactgggcttaaaacctgggtgatgaaatagtatgtacaacaaaccccatgacacttgtttacctctgtaacaaacattcacatgtacccccaaacctaaaataaattaaatgttttaaaaaaagaaatgcttggaagctaaaaagacaagcacaactccaaataatttgaggatgaaagataagaagagtgttgggctactgacaaaaatgaggatgtcagagggctgtggtggtggagatggaaagtggtttaatttagatgtgagcaagtcaagatcacagcagactgcccaagtggaattctcattcttttgttactgccacagttgcagagcccaccagcgaagtctgggacagagatggtgggggcacctatttcccagcacaaaccttttcaacaactactaaaattcctggtcaaaatgaaccaaacctattcattctttcatttaaaaaaaattaacatgtctttccctgtaaaaaaaagaaatgaatttttctctttcttactcaaaaactgatcttcagaaaatcattgaaatcattcacgattctgaaacttttgctgaaaagctttgatgtattaaaaagaataattacttaaaaaacagatcctttgacactccagattggaatttgatgacttttttcccacagtgattcaattaattggtttttcttaatgtttaatggtagcaaagtcatcacattgaagaaaccttatgtcatttatcagcttcttctccagagccctgagaacacctgatgattatttcaatccaaccaatcactcactgaacacataatcatgaataatttagtagagcaatagatccattacttaatatagtgctaaccttttataatgcttatacctggggagaggactaatatctgtgtcacagaataactgatatcaggccttgggttttgaaggtaacattgtgacttatggaatatctaaacgcatgcaattataaaccacattatgggaaaatagttaacctttgtgtagcatttaagagtttacaaggtactttctcagacattatctcatttgatactcaaatcaaacctgtgagaaaggtattctttatttttttttaatttaactgacacataattgtacatatttatgagttatatagtgatgttgtgatacatagaatgtatagtgatgagatctgggtaattagcatattcatcaactcaaatacttatcatttctttgtattggaaacattcaatatcctgcttctatttgaaactgtatattattaacagtagtcatcctacagtgctagagaacacaaacttattcctcctagctagctgtaattttgtaagctttaacaaatctctccccatgtctcctttccccctacccttcccagcctttgctagcctctgctctacttttttcttcgattagatgaatcatttagcttccacatatgagtgacaacatgtggtgcttaatgttttgttcttggcttatttcacttaacgtaatgaggtattataagtgaggacagcagggctcagagaggccaagtggtttgcctaaaactgcctagctattaagtggcagagctgagattctcccccgacagtctgtgctgtctcttgtaccagtattcactctgatgtgataaaggcccaaatgccaacgggctttctaaagtaggctctctccattccacacagcaccaacagcctacccatgtgagggccctgttgcccttcatctttgttgaccacctccctctggtggccaagagttctcacatgagaaccttcaagaggagcatcataaactaccatttctagagcaaaaaaatgcttgtttctcaggaaccaaatcacacatgagcatttctgcaacatatacccatcatcctgtagcaaaggaagccacacatctggtagtaacaggtgccgtattctttttttaaatgattcctgccatgtgacagttcatgtaaacagcacacagaattctacccaatcaagaattactctttatttaaaattcttaaaggagacttgccttgctgtaagctaattttgtgaaagtttgttttgcctattcaatatttagcttgatttccgaaactatctggaacagtctttactaggtttgtctgtttctctctctgagactgcctataatagataaaagcaatgctttatttccataatctgctcttgagagttcctcattatgcttaaatgtctcccctttgttttaaagggtattatcctgcattcaatgcaagaaattaaaagtgtcattagataaaactgacatttcttttatagcaaaagtaaactcaatccaatttagaatagtatgtcaggttccatctttacttgttagataaatcactgttacaataatcttcattttcatcttattattattatttaaattttttacttacaaataacagcactccaaggatcatgtaaaacttgaatttaaacaaagttctgggaaaggtggctagtgattcagggagaacagcaaagggagatatggtttataattacacctatttaggtaactgtgccaaatccctttagaccagtgaaagcacacaacagagcagatcctttcccactaaataaacaataaataaataatttaccatgatatggtgagccttgagttttcccccattccttccatccctcgtattagtcaaggataatttcctgaaatatctagtattaatgaaactcttttatgaatcaaaattgtaatcatttagaatctgtgctcaaaagatgtgggtggtttgatagtcaaaatcacattatttaggggaacttgtagccagcattccaaattcaatttattaactccctcatcaatagccagagtatttgacaatttattcaaagctttcaaacatagcaagagacaataagaatgccgtgcctagtgctaaggggattccaggcacattatcagaatgggggcttgcagtgtaactaaccatttgtggatgcatgggacagcaacatttcctgagacatgggacttttggtgctaaactcaagacagtcctagacaaaccaggttagtcactctagggtcaggttgagggaaaaccttcaactagaactggggcacacatggagaaggatttcttcctagaaacaggagaaaagctgcctcgctgaagccagagcacaaggtcagagctggactcaagaccttgatgcaagagcaacaggagtattcagttaaagctttttaccaactaccgactgaagacaagattggtcccagagcaggagacaggctgaatcttggagtagagatgattacaccacacagtgaggaggaatatgggaataaaatatccatatttactgaggggataagaagaccttatcctcctggcctgtcttctctttgtgctctcctgttagctgaatccagtcagctgtttttctttcatttatgccaggatgcatcactttatacttaagcatgtgtggacagagaaaagctcccactaaaacactgacataaagagaggaggatcgcaccagaattatagggcttccctgcttttgtgaaggaaaagtctttaacgttattataaacataatatatggtactcagattggggtttctgttatattgaaccattttcattggaagacaaagtttctctcccctctttccacaggcagccagtacacattgttgtctccattgtaaccattattttatttttatttattatttaaagacagcgtctcactctgctgcccaggctggagtgccacggcacgatctcagctcactacaacctccaccctgtgagttcaagcaattttcgtgcctcagcctcccaagtagctgggattacaggcatgcaccaacatgcccagctaattttttgtatttttagtagagatggagttttgccatgttggccaggctggtctctgactcctggcctcaagtaatccacctaccttggcctcccaaagtgctgggattacaggcataagccactgtgcctggccaataacaaatattttaatttaaaaaaaaaagaaatcacccctttgtgggtaggaaattcttttgtaaagacagggattcacgagtatgacttgctgccagggtgaggactgtacacttaggacaaagcagatgagagaaccccaagaggaaagtagagaactgttgacattcacctcttcccaccagaaggtttctctctcagaactaaaagttagtgatattctatatgctgatttattttactaaaggagataaatattcctttacaaatgaagcagaaatatggtgtcatgattaagagcatttgtttattccactggttaaatgtatgatcctagttttgtaacctctctgagacaaactttcctcatttgataaatgggtactataacccacaactggcagggattttctgagaagtcataaaatagcaaacgtagaatgctatgtccaacattagtaggtgttcaacaaatgttaattattttccttcctttttccctgccaatatcctatctgaaaacaaacaaataggtcactatcaaatttgaaaaattattcgtcatcacgatttattaccaatctcagtaacaggatgatgggcacattcagttcattttcttttaaatttaccttagctttcaacatctaacttgtctttaaaaataccattcactaaaataagtggatatctggtagagacaacctgatatttgtacttgaaatattctaaaatgcacttggacaatcaattcatccactcacttatgtgtgtatctgtcgacaagtgtgcttgtttctacataaggatcattatatacaagccccattctgagcgcctctgtgtttgattgttttctaagaaaaatcatgatttccaggtggaacagtgagtactaccctttaaaacctctgaagttgatttttacttatatcacaaacacaggcatcaaatggaagatgagataaagttcaccaccagctttgaacagtaaaaatgacagaaattgggagttctttctgaaataatgcatagaagtcaatacagccaataactcttcctaaaccttgtccaagcaaagacgcttcaagtcaccataaaccatgatgtgtcccagaagctcattgaaaacaatgagctagcacagggattattttcctcaattttgacttttattactagtgaaaattaagagctatcaccatgtgtattctcacaagcacattatatgtataaataaattggtttaactctctcaataattctgaactgaagggactatgattatccccatgttaaagacgatgaaacttggaaaataacccagggttttagaactggtgacagcaaagttaagactggaacgtgtctcttgctgaattcaaagcccataatctctagccattaaactaggtaagagaagaaaggtaattttttctttttggaaatattataatcctgcctaagaaaaattctgaaacaggccatttcatcttcagtttctaacagcattaaataatgtaacagaataggtaccttcgttttaccttccaaatcgtctagctagtccaaatatctgggtctgcaaacggcattttctgagtcccaggttccagatcatccttactatttcacagaaaataacatcactgccaaagaagttatttctccaaagtaacttcttagacttgacgtatgtagtttaagcaaatgtcctttaatgttctcttcatcgtggctggggaaaaaaaatacctaaaaagctctgagttttattcacttcaaaaaacggaatcacaaaagatttgaaaaaatgtcctagtttttcaactcaactttaaaaggttttttcaaatggttaatttgatatcctagagtattcagcaggatcccttaatgaacttaaaactggactttttttctacagacttggtgttcagataatgatttaagaccacctcaccctgccttctttgtgcatggatgtcattagactcaaagtcaagcatgaaggtgaacagacattaatgtaagaccacttagagctacgttctctgcatcactcacaacaagcctcctttattagcccctgacgggggattcattagttggtcggactggatcaaaagctaggtggaaataacccttcctggcaactcagacgtttttcctatttctcttcttatttgtagaggtcagttcatagataataggaaacactgtaactcaaaagataatgtggtctctgaatgcaaatcaaattaatagattaaaaatatggtgacatggttgaggttcatagttgatcttttctatatatacatatttttttttgccagaaataaatccaactggcctcttctccactcaagattttcaaactgaatatcagacccccaactgaaattcagtatggtaaaaatagaaataggtatctttgctttcagtattttccctctctactcccacatgcccagctttgctatgtggaatgccactgataccactgaaattaccccctgaactccagtttctctccattccctttgattgctcagttcttactcaagctgtcttcagtgccgctcttcttcccaccgagacatggtgaggtttatgctgttttcaggcatagacaactagcttccaccattctgtgtaatatatcgtgtttccttgcctgtgcacacctggttcacccaaacatcaccctgtacacccaactaccctgtagtctcagctcagcaagcattctcccttcattttcctcatacttgcatttgagggtgtcagaagctctccctatctgcacaaactctccattcacattttactgagccagttctttcatacccacaaagagttcttatgtgcgcccctcttccaataggatctctgagactgctaacatatttcctaaaagtttcccattatctgtagaataaaatatgatcttcagcctggcctttaaggttctccaaggtctcactgtgtttgtggatttttttttcccaaccactccagattatattgatctctgaaactttttagcatttatatctgcatcatttgttctcaaacttatgctttcttccactgtttcatgagaattttatgtctgtttgttgcccatcctgccagcactaaatgctgaaccctcatattatactttttttttttttgcagcatctggctcaacacacaaatcggggcacttaaaaatattaattcagtaagatggaatgagtgaatgagtgaaaatagagtgctacctagaaacagagaaacacaaaggatgttcaatttggggagagaaagctgtaggtgtttttccaacccacatgatacatcttaaacattatttttagggagttcttgaagatgggcaagataaggtcagacactgttctagttcacttttttttattttgacaaggcaccaggagagacaaagctagcccacctctctttctttttttttttctttcttcaaaaaaggccatcctcgcttccttttcccttttccttcaaaaagtagtattctacaggaaaaactctcagaggaggggagagaaagtgaaggggaaatgagaaggagagtcagtcatcaccgccacagctgtaggaagaacgccttcctctgcccagaaggcaggaacaaacaccacccgattccagcccactgagcagacctttgagagggatcaaacttctaagtactggagggacctagaaaattgcttaaaagccaggaaggatcagccacacaaaaggcatgcagggcagaaggccagtgcctctggatcactctgaacccatgaacagaagagcggagtaatggtccatgactgcaaagggggcagatgagtaagtacagagagatgatctgcgccccatcagtgaaaccctgaagatgatccttcaggatgcttataatggttgcaggttttgagaagacagatacttttagaggggtcagggattactagctgagaagcttccacttactctttcaggaaaatgaaagtacaggctctgttctctgcatcacccacaagactcgtttattaccccccaatggtgtggggacctttattagtcaggggaatgattattattttgtctaactccacaggctgattggcttggctttcccaaagtctatgaaactaaaactgaccccgcaaattaatagaaacagcatgagtcatttgaagttcaagttttaggagccactcaggttctcacgaatcatgaggtgggagcaagccaccagatggagggctcgaagagagacccagccccagaggatcctctagattgcaaccagcttttttcagacatttttatatatataataagactgtgctcctccaactagacagaaagtcctgttgaatatgagtcattggctcttaaatagtttgaagtttttgtaaggagtttttgtccttgaaaatccttctacagacaagactgaaacattaatcaaaccttaggtaaccaaaggagtatcctttcatttaacttgtgttttcagcattatagaagttttagtagtgctgtaatgtttcacatacaaattgctgtaatgtgttttgcttaataagacttggaaatggaagtagttgctactgataagcccagatggcaatacaatagtatcctgaattaatctgatattccaaacaattttaaacttttaaataatagaaggtagcaataaaatagtattctgttgattataatctagaacatgggcaacattattggggtaggggtggctactggggacttcagtgtaaaactcagtctttttgtcattcatgaaaatttaattccacatagtcaatgttttacatttccaattttcattcacccatcacatctgagcaggaaattgtgcaatataggcaaaggacaaggacagcagagggtcacaatatgtgtactggaaaagaatgaggcagggggctgctcctcctctggggacagagcttctgagatgtccccacttgccctgttctaggtgatgagtctcagctttgtatatccagcaactcaattttgctagccaccttggaactggctcacaataacccacgctatcatttgaaatgagaagatgattttcagacatgcctctcgagataacccaaagcatccttccccattatacaagttgctttgcctgtaagaccaaaatatttcatccagtctcctggccctgtctcctaacagtgctggatattaatcaactgccttctatatgctcaccactcccccttttaaaagctagactgataatatctcttgctggcacctcctcttggataagttagtgccttcctcctgccacagctggatagttggattcactgacagagtcaagccctgcctagggctcaccctgatctcttgattgaaaactttggattttaagatgctcctcaggtgttcatgagtgtctcatttacaagcagtctcccaagcagagtattccaacagaagactggcttcatcctttgtgtattcttgaaactaatttcattctcagagttataggtgtgtttccttcctatagacagccacattttatgtaggagtcttactcattttgtataaaggcttattttattttcccagagatttctgtggtaagaaatgctgtccatagttaagttcctagtaaagatctcaggggtaaaggtgggagatgggatggtggcagccaggatcttataggttcaccaggtgaggctttaagctcaatctataggttacccagttaatcacaggtaacaaatagtgttttccacaaaatgtagcattactttaagtcctttataattacatatttcccacaattacttagctaatggaccactacagaaaatttggctatattcatagtttagtaaaatggaagtgattacaaaaaataaaattgatagaaatacactaaaatatttacttgataaatgcattcataaattagttttagttggaattttaaacttttagtcagggcgaagtatatgtggggcagggggtcggggggaggtacatctaacaacagagaaatcaggaataaataaggacacttgtcttattatccatgatataaatctaccttctttggttttgaatgggataatgtggagggagtagtagtggcctacgaagccagccaagaagctgttgaatctaatttatgacatagtccagacctgtttttgagccacctgccaaggggattcttcccattattgggggagggagaggaaggcatgtgaatagccagcactaaccacctggttgggctaatgttcactgggatcctgaaagaaagagggcaaaacagcctgctcacccatacctgtctcccaagctcccaccagtttcactgacaagggtagcattagttaggcgaatgactccctatcttattcacctttataccacccaagagcacccagcagaaggcctgacacagagacagtgctacaatgtttaatgaattgaattgtatgctggccaatattaggctttacaattgttaaaagatggtttgatatgcttagtcttgtcaaaaacattgtatgtaagaagaagaaacttgagaaaggtggtcagtagagagcctcttcgactaatagacagtttgagcatctgacagctgcattagaagcagaaattggtaaacaacttgacatagtatagcaaaacattcatgaaggcagccctgaatcccaaacagggatggataacctgaggacaaggaaagaaaaatgaggcaaatagacttttaatgctgtaatatacattaaacagaagccctctatttctgttccatgttcagatccatcttgagagcacagcaaacactcagagtatctgggggagaaggtcagttttcattcatcattatcagcaatgaatagttactaaaaggagtgaggctttgagcccaggaaagcagaaagaacagagagagtccccaaggctgggatgaggcaggaagctgctcaggaggattagcgcctgacgtggaagtggtttcccattcttctcttttattcctaagtttcctccattcttctcttttattccttaagtttcctccaatgacgacacccagatcttaatgccctttaaggagtccctgaagagcaagacctggtagggaccgcccaggaatctggtggctgactagagccccaagctgttacagggccatttgctctgctcttggccatcgtgtccattccaaaactggctttggcattcattgggctggtctggctcaaactctataaacaaatgcccttctaagtaaggactgcccaagtggagaacagaagtcacgtcagttatgccttatcattctcagggattcacagtattttagagctgtctgtggttaaacagtggacaatttaggccaatcaaagccattaatgaggaagaaactaaagtccagagagatggaatgacttccagggtcacacagagcccaagggtgagccagtccaatccttcgaccactacctgcaccccatatgtatgtgctgttctccctttatagccttcgttactgtgtgtcccatattatttccatattattttcctaagtccaggtcttcaatggagtgtgtgtgcagatgtgtctgtgtgagtatgtgtctgtatctgtgctgagcagggcaactgtgctggaataagagcttcaagaggtcttcagagagcccaggtattcactctagccctctctctggtgttcagccaagcaaatgtcaggagttttcataagtaatatttctctaactggcttgttctttcccatgtaacccagatctcaaccagaatctcttccttccttgaaatttaaactgtattcccctaaaccttaatttgttcttcatgtgcatccatgaacttcccccaaattgctgtgatttccagagcaggttccagccttgtgtgcttctaagctccttttctaacacaagttctagttatagcctagctactggggtgaaggtgacattctctgtcctatatcatatgtgaaaatcaaaccccttccaaagactcctaaccaaaacaaaataaaaaccacccacacagggccactgtgaatacgagagtatgagatatagagtcagtttgcattaaaacaaaccacttcgaactgaccagtagacatgcccattttttaattacgttctctgccaggtaacaacccccttggtaactcaagttttaccatcttcttaacttatttttactcttctttctcattatcttgctccccctttctcctcctttcaagattgcttgagattctgtatccttcttgttctactacttagaagtagcaactctcaactggaggggattttgttcacgggggaacatttaacaatatctcaagacatttttggttgtttcagtgaggaggtaccggaacttgacatgtagtaggtcgaggccagggatgctggtaaacatcctgcaatgcacaggacaggtcctacaacagcaaattatctggcctcaaatgtcacagagttgagaaggctgtaggttgggaaaccctgatctatagtgacttggctatagccatgtctattcaaataccaactacagtcctaggcatatccaaattctttccaccctccttagaacgtggcaatagtttaaaatagcattttcttacttcggttgcactaacaagatccagatggaatgtcacctcccctggcagcctttcctggtccctctttccactcctccatctgtgctttcatgacactttttacacaccaccgtcctaccatccgtctaccttgttagaccatagccgcttagcagcatagatcattcccttttagctcctctagcacagttcctggcatagaattggtgtttaataatccttgtagaatgaaactgaatcttcagagcagctcctccaatcttagtatcaagcctgacagaagagtggcgattatcatgatagctgagggcaatcataactcttgttagagaaggtacaaatgtcatggggatgactatatgatgatgcacggtacagccttggttgaaaagaccacacttagtgtgaagatccaaagatgactcaacatggctcttagagacacccattgtcgacagaggatatcaacctgagaagatggtccccatcccagttttcagtgatggcatcacagctttcaatttgcattgcaatcagggctattttaaaggaagaaatgtaacagcctatctaaatattgctaaagcacacataaatgccaatttttcttgactaaggatacgtggtataattattttagaattaggagtaattttccaaagctttgtaagcacttcattaagtaatagaatttcaaatagtaacttctagataaacaatcggttggtgagaaagaaaaattgacattcatctataaggaaaaggatgtatgaaagaaataggaaatttcaacttaacacttctaatcaataattttgatctcatcttccagatactgttacatcaagccatccaaccatgatatataagcataattgaagtattaggcaatgacatttatttatatatacatgtgggctttgtgtttcttttttctttctttctttttctgagacagagtcttgctctgtctctcaggctggagtgcagtggtatgatctccgcttactgcaacctctctgcctcccaggttcaagtgattctcctgcctcagcctcccgagtagatgggattacaggcacccatcaccacgcctggctaattttgtattttcagtagagttggggtttcaccatatgggtcaggatggtctcgaactcctgaccccagatgatccacccacctcagcctcccaaagtgctgggattacaggcgtgagccaccacgcccagccgtgtattttttaaagttaatgacaatcaaactttgatgccttctaaggatagatatttcatcatttcctttatttaaagataaaaacaaatagaaaatagcagtgaggaaaagctaacagctacagaaaccaactggattttgcatgacatcttccctgccaaagttcatgccagccgattaccctttctctaccctgcctcagcttcaaacaactcccctagagcaaatcctacctactgtagacccagtagctgtttccccttttttcttcctcagggactactggttggcagtggccatttgcctcgggatacattggccctgccagagcccaactggtgaatctcagtttagttagttatacccagtatttatcaaacaaaaaggcccccaatggagacttcgtaggtatttttttttccttaagtactcccaaacctccgtccccatcctgtaaaagtttaattccacagatacaatgtcctttggaggaacataaacgattgtaacacctaagattatttttgtccctgtggtacacagaaaaacagccccataaagacatccacattctaatctctggaacctgtgaatatggtaggttacactgcaaaggaaaattaaggttgcaaatggaactaaggtagctatccagctgaatttgagacaggaagatgatcccagatgattctggtgggcccattgtaaccacaagggtccttaaattgggaagggggaggcagaggagtcataaatgagaaaggtcatcataaaaaaaagactcgcttgatcattgctggctttgaagatagaaggggaccatagccaaggaatgctggcagcttctggaagctggaaaacagagcaaaatagattaagaaaggagcacagctctgctgaataattaacacaccttaattacagcccttaattattgggcttctaacatccagaaatgaaagataataaatctatcttgtttaaagccactagatttgtggtcatctgtaatagcagcataggaaactagcacatcccccatccccaagaaccaattttggtcaccacggtggcaattctgccaccactgagaatgtatagtctaactcagtcattgtaatctcactcctttcccaggtattaatttaaaagtaggcatgtgactgaattctggccaaggagatataagcgtcccctggaagtctctggaggctttttggctcttaaaaaaaaaaatggagagattcattttaagacaaacttccctttgtttttctatagatgtcaccatttacttgtgatccctggacctgctaccaggagacaatgagggctgactgataagaaagaccacatgctaagggtagaagcacagaacagtgggaaggagctggatcctcgctgcctttgtttgcagagggacacaaccagccaacacacttccagacttcttgctatataggaagaaaaatgcactcattatttaagctagttttgggatggctctttcctgcttgccatcaaaagcaacctttcttccctttaccaaaaataaacgcattctataaacaaaacattcatcattcagtatccccttgttagctcaaatttaatatggtcagcagcgatatttaagggagaagatttcggtgtcagagaatatagaaatgagattctaattagagatgtttagcagacacttaatccctagaatagcacgaaaggtcctttctgggctagcctttgcccagaacagcctgttctctcataccccatttcccccacctgcctccaccctgaactccatgtatcctgtgccccagtcacactgaacagcttgccattgcaaacacatgcttgccttctccatccctgtgcagtagagcaggatggtccctagagcccttttacctgactaacaccttctcattattcacaatgcaatgcagatattggcttcatggagccacacctggcatcacccctacccagagagagtgaaacattagtaaccttactttacctgtgttcccacagaaccttaggtacatctttgccctgtatttttcaaattgtcagaagtgctgtaattgggtgagttaatgcctgtctctctcccactaacctggaacccgaagttagaaactgtggccttcatgggtaaacccccacacctagtactgtgcctgggccagaaggggagggaggaggcagagggaaaaagggagagcaaatgaatatgaatgagagagtgtgagtctggagctcagatgagacatcagaactgaagatatcatttggggagtcatcagcatagagacgacaattgaaactgaaagcttgtatgagattgccaagaacagtttctttagaaatattcaccatcacgggtgggaggaggtaaaggtgcagagagagaagcatgggagaaggaattctgagtgctgataaaggagacaatttctgaaggtatcagcagtgctggaggatgcaaaggggtcaagaaggaaggaagccaggaaaaggccttggacttggcctcagaaagaacctctaagaaagtaatagtaatttcaccagagtgagtagagaggaagtctagtggcaggggattcaagggagagtgaacacagagtcagtgggtacacactgagcccacactgctcctgcagatgctcaccagaaaaggaagagaacaaactataccgctctttgccttctttcattccatattcacatgggctgataatcctgaaaacatttttatttaattaaaaaatacaatgcctttatatattttggtctgttcaggaataagctctttagggattttgccaaaggggatataaaatgtagtccattctgccagggctggtgtggcagcctggggattggttatgtggtatggattcaggggtgggcttccttgttccaatagaccaggaacaaggaaacctgagtccctggtgctagtctttccttgtaactcactctatgatctttattaagttattcatgtctctgggcctcagtttctcccttcttaacctgctttagttctcaatcccactcaatgataccaggaaataattcgaccagtcaatgaatatttacctattagttcaatgtgcaaagcattaagctaagaggctaatggaagtttccattcttctaatggaaaactctgatccctattatgacataaatctctcctgggaaagtaacaatcttagctgttattagtcattaacactactgcgtaaatgtttcctcgattataataataatggcaaacatttcttaaaagcttattgcatgctggatcctaagcttaaaactttacatgggttttctcttttaatcattacaaaagccataggaagtcaagaacattgttaaccttgtttacagatgtggcaggtggggcttggagaaatcatttgtctaacatagtcacgcagtgatgtcactaggcaagtgccagagcgggatcggaacccaggcagcatggcctcaaagcctgttgctttagtcagggttctccacagaaacacaaccaagaggaattccctcttgctcagggaaggtcaaacttctgttcagtccttcacctgatgggataagaatcacagaaacatccaaaataatatttgtccacataccttgtgcaacttggcccagataagttgacacataaaatcaaccatcacacttgtgcacttaacagaacaaggtactcaataatattttttaaaatattagttcacctcaaagcatttctttttgttttcctcactttcgttgataatataattattcacctaggtgccaaagccaaaactttgagcaccatccctgcctcttccttctccctcactctgtataccccattgcttgcaattgtttgattctacttcttaaaggtcttcctactagtcacctcatctccatccttgcaaccacagctttatttaggaccttgttattcattgcttggactattgcaacaccctactaactcaacctgctgcctacagatggactgaatctctccattcatctttcagcctaccatcagaaggaactccctcaaacacaaatctggtcacgctgctgccctttatataattcttcaaatgccctacctccttagtttggtttaaaaacaaggtccccccatcatccctttcctaagcccccatactccttgcatcctacctaacaacaacaacaacaacaaaatctgcttccttgaaattgccattacccttccttggttctaaacttttgcaaatgctgcccccctctttcacaaaaggaatgctgctcccttttcccccaaaatcggctcaaacaccattattgtctgaaagtgtttcctgatatctctgggcaaaataaagtaccttcatccctgtccttccagagcttcagtacagaatttaccaaccactgtaagtaacaccccctctagactataaatccctaggagacagtgctatgttctgttcatttggggaacctgaacacctgacaacatactacccggaaatatgagaacaagtacttcatacatgtattggagaccttagcagagatacaaacttctagagaatacatttgtggcttatctgctcccttagtgagggaaaaaagtacttagtatctcataatgtaatacggggcttaaaaatcattgaaggtgcctaaaaatagcaagtaggtctacttttccttgggaagagttttgataagatatttttgatcttttaggagttaaaaagatgtttctcaacctctaaacagagttggtgggcaaggcagaatggattggtagaatattaaaaatagagcgaggctaggctgttccttcaagatatttgcaaacactagaatttttaaacacaaaacagaataggagttggaatattttaagaaaataagtaaaaatgtagtcctcttgctatctccaacagctatgcatttgagtacctgaaatgtgggagtagacgaaggggcattagatacactataaaccatgtttgttattataaataacacataaaaccacagagcaccttcattatagattaatgttacagttctctgtggacacaagaccattgacaacatgggggacatgaggttgtaataagccttagattctataagtcaataaaattaagccatggcacaattgtgtcacatctacagaaaggcagagtagatcatcactgagggagacagtgattctaagcctcactcaccttggccaagcctgaagatcttgagaagtgtttctgtcccatcactaacttacccactcatactggtggtgtcagtgcaggagtcactgctactgaaggctggtggaaggaaagaccacaggttgttttttgtttttaaatactttaagttctagggtacatgtgcacaatgtgcaggttcattacttaggtatacatgtgccatgttggtttgctgcactcatcaactggtcatttacattaggtgtttctcctaatgcaaaccctcgcccaaccctccacctactgacagaccctggtatgtgatgttccctgccctgtgtccaagtattctcattgttcaattcccacctatgagtgagaacatgcagtgtttggttttctgtccttgtgatagtttgcttagagtgatggttccagcttcatccacgtccctgcaaaggacatgaactcatccttttttatggctgcatagtattccatggtgtatatgtgccacattttcttaatccagtctgtcactgatggacatttgggttggttccaagtcttcgctattgggaatagtgccgcaataaacatacgtgtgcatgtgtcttcatagtagcatgatttataatcctttgggtatatacccagtaatgggatcgctgggtcaaatagtatttctagttgtagatccttgaggaatcaccacactgtcttccacaatggttgaactaatttacattcccaccaacagtgtaaaggcattcctatttctccacatcctctccagcatttgtttcctgaccttttaatgatcgccattctaactggcgtgagatggtatctcattgtggttttgatttgcatttctctgatgaccagtgatgatgagcattttttcatatgtctgttggctgcataaatgtgttcttttgagaagtgtcagttcgtatcctttacccacgttttgatggggttgttttttcttgtaaacttgtttaagttctttgtagattctggatattagccctttgtcagatgggtagattgcaaaaattttctcctattcgcaggttgcctgttcattctgatgatagtttcttttgctgtgcagaagctctttagtttaattagatcccatttgtctattttcacttttgttgccattgcttttggtgttttagtcatgaagtctttgcccatgcctatgtcctgaatggtattgcctaggttttcttctagggtttttatggtgttaggtcttacatttaagtctttaatctatcttgagtatgcatatcaagaatattggaaacatacctattgtcaatagagcgggccctctggatcataaaatcgaagtgaggaagaaaacaaaggcattcatgccagaggaagcaaagtttttggtttgtttttgattgttttgttttgttttttgagatggagtctcgctctgtcacccaggctggagtgcagtggcatgatctcggctcactgcaacctccaccttctgggttcaagcgattcttctgcctcagcgtcccaagtagctgggactgcaggcacacgccaccacacccatctaattttttgtatttttagtagaggccaggtttcaccatattagccaggatggtctcgatctcctgacctcgtgatctgcctgcctcggcctccaaaagtgctgagattacaggcgtgagccactgcgcctggcccagtatttttttaaacaattcagaaagctatgtatccaaattccgaagcaatcttgagcagtcatcaatgaaagtctttaactcagtgaagcacacattgtcttaaatgcctttatctctttccctggtctctgtctacatgcacctccccttccttcagtacctagcccaagcttcccctccataaagccctcccataatgtccctggttggaaccagtcacctcaacctctgcacctgcatagtttatgtgtgtatatctagcaattattttctcatcttggctctaaactttgaagggcaactgttgtgtccgtctccagtgcctatcacagcattgtgcccatagccagggtgcagtgcatcttatggaatgtgaccaagggacatctcctgttttagcataaataaaagaaaccagagttctgctcttgttccaccttcattaatcaagtcctccctccagcttgttgtttaccagcaagggagagaaaagctgaactcacaagttcatgctgctgagataaagacctgaagcatatgttggcccacagggagggctcgatgccaaaagctggggagaaaactaaagtttctccaaggaaaaaataaataagggtggaaaggagagcacctccagttaaggacaggtactatgacacctgacaccaggaatgcctttgctgctaggtgcttccttaactgtgacaggacattaacacaggacctgcagctggggcaggagaaaaagagaaaaaggagcagcagagaagaaaccagcctcagtcccaggcccttctccactgcagggttccagcttagagcaacaccaagctgtgggaggggagaaactttcagtttggctgaatttcagttttattacacaggactggacattttaataactgaaatgagacttttcatatatttagaagtgaatagagaacgaagagtatgagaccaatataccttccagatgggggtgggagaatcctagacttcacaggtgtaaaatcagtaggaagaggcaaaattaagaagtttccaaaaacaaaactcaaaccttgaggacattacgctaagtgaaatcagcccattacagaaagacaagtactgcaagactccatttatatgaggtatctaaaatagctaagttcatagaatcaaaatctggaatgatggttgccaggaactatgggaagagaaaaatggggagttatttaatcaatgggcaaacagtttcagtcaagcaagatgaataagctctagatatctgctgtacaacgctgcacccacagtaaacactaatgcagcatgctcttaaaaattagttaagaatagagcttatgtttaagactttttaccataataaaatgaaataaaaaaatgaagaatctaaaaatttaaaattttaaaataaagaagtggtactgtggagtctcacctatcacatataccagttacattgacattttaaaagtcagtgctcaataatagggctcccccagagtgccttgcctgcttcacgattcacagtacaaacaaggcttccatgcttcctgacaatcacacatggaattccattttttaaatgaggaaatgaaaaataatttagaaaccataaaaagaaataaaatattttctttaaaaatagaggactcagccatgtttatgacagtcaaacaaaatgtctatttctctcctttttgccagggctcctctgattgccatccaattagctagtggtcagagtgacccattagtgagaagtcctgttagggaagccctttagctggtatgcaatatgtgctattttcactgactggactcaattggtggtggtggtggtgagtgaagtctgcattctgccacagataactaatgtgtaggtagatgtggttcctctcaataaccatgaaggccctgggttaattcctttggttgccaacacactagggttggtgaaggcagcacagaatggagagcctttacaaagctggggagaatgctctaacagaagctttttcttgtccttgaaactgctttgttgtcatttagatgaaagccaaaactatttctgatgaatattatgatgcatggttacatttagatcctatttttcaggggaattttggctactgtaactgaatttaacatatgttgatagagctctttcatgccctgggcactgatgaataagaccaggttgctaattcccctgagaaagttacagtctacgtagaacgcagtggtgtcaatggactgacaccatacagcatgtgcaatggacatctgtgtggttcacctgccaggcagctcttcttcttgttgtaggagagcatcacactttagctttaagaaatgacacctctctgtggctttgaccatatgtttcaagtggagctcaccccagctttctctccccagctccagaaatgggcatatgtcccatgcatggctaaagtgaatagcaccttccccaggccacagtgattgcttgagtgatgaactgtcacttcttgtacagtgggggccaagccttggacttctgcggacacaattggaagcgaagcacatcctttccactaaaggtgctgtattgggttgaactatatcaccccagaagatatgtccacctggagcctcagaatgtgactttatctggaataaggtgtttgcaaacataactgcagtagggaattcgagatgagatcatcttagaatagagtgagccctaaatccaatgacaagtgtccttataagagacagaaaaggagaaaataacaaatacacagagagaaaggtgatgtgacaatgaagccagagactggagttatgcagctacaaggcagggatgccaagaattgttggcagccaccaaaaccgaggagagaagcatggagcagatcctccctcagagcttctgtaaggagccagccctgcctacaccttgattttggacttctggctccacaattgtgggagaacaaatttctgttgttttgagccacccagtgtgtggtgatttgttaaggcagctctgggaaatgaatacagttactaagctggcagtatgcaagcctacagctgctggtggccatcttcccaccacatgggcaaaacctaagcatatagccagcacaccagaaagcagagcccagagctggagcaagacacattcctgtagacttcattttaaaatgtggagctaaccctgcctgagaagtcagatttactcctatactgttttaagtttttgtaccctaaattgcctcataggcttacatttaagtcctgtctgagacagtaaaacaaatgctttctttactaaaggtacacacacagtgttgcaatcacagaatagagctcatctaacactacttaagggaacccaggaagccttcactaaggaagtatcattgatgctgagtcttgagtggaattttgccaggaaataattcatctgatgtcccatctctgcatcattctctgtgggattctttctggggagccacatagtcattctgcacatgcccatcccaatctaagggctccaggacacaaactgcggttggccaagatgtcttaaatgagttttgtttcaatggcatagatccccacagcatcaagtgattcccatcctccatgcctgggaccttgtgaccacttgtgccaataccaacttgcttctggccctcattcccactccagtccaagccaatcccagctcttgcctggagacacacaatagatttctaactaatcttctgcttccatcttgaccctgcaatccagtttctgcacacgtacctcaactgtaccatatctctccaaatcaaatcccttcaaaggcttttaccagatctgtaaattcccagcacctaacaagttcttggaacttcatttgggtaccaattatgtgttaaatgaatggtgaataagcaagttcatcagggcctggagtcatgactcaatagcagaagctttagaccttaggacatcttgcagtcatgactcacatctcatgttacatacctggaacattccaaaccaattgaaagaggaataatatattcatcagatttatctacttctgattttgcatccactctatttgtctgacatagcagatctctggttcttaatctaagaatggtagatctactatctggttctggttttcagattcaagtttagcaacctgggtgtcaatcctgctatcatgtacttaagctactgcttctgtttcccaactgaaacctgtccctaattctgattcccggctctccttccttcccatgtgccctccggttgcggcactggcatgccccagaacccagatcccatgtctctcaactgttgctaaacagaatgagatgctgagccctgaccctagggcagggtcccatcctctgctacagaacaatttttatgtggactgttagccacgccatctgactttctccaagctacctacttcctgatgtcctgtctccagcatgcactcacctgccatgtccatctattccttcattcaacaagcactctcagattatcttctagacagtgcagctacagtgctaatgaaagatgtctgtggtatgctttccacctctgaagaaaaagaagggaataatttaaaaagtggtaagatgtctgcatgggacctcagaaactgaccaagtgttcacagtggttcacctcttaccctcttactttgccttgacagaactttagtcaggattctctccttcctacaggtccctgaattctacttggccccaagcctgagaaagcactaaacactggaatgtggcccccttattagcttgcactgagaatcagctgaccacagcaggacaattcctgtcataccccactgatcatcctccccatcccactggccatcccccagttccactgatcatccccctgtcccactgatcattcccctcaaccatcccactgatcatcctcccatcccactggtcatccccccaccaccatccccgtctcactgatgactggtcatccccccaccaccatcccactggtcatcccccccaccaccatccccgtctcactgatgactagtcatccccccaccaccatcccactggtcatcccccccaccaccatcccactggtcatccccatcccactcatcatccaccccatcccactcgtcatccccccatcccactcgtcatgctcccctgtcccactcatcatcccccgtcccacttatgacccaccccaccatcccactgatcatcctcccatcccactgatcctctgatgacccccctgccatcccactgatcatcccctcctcccactggtcatccctcccgtcccactgatcatccctccgccgtcccactgatgactccccacccccgcggtcccactggtcatcccgccgtctggctggcgaccccccggccgtcccgccaatgacccccccgccggcccactcatcattccccgccggcccactgatgactccccctccaacccactgatcatccccgccatcccactggtcatccccccatcccactgaccatcccccatcccactgatcattccccgtcccactgatgaccccccccaccatcccactagtcatccccccgtcccactggtcatcacctcgccccactggtcatcaccccatcccactggtcattcccccgttccactggtcatccctccattgcttaatcccttttacaattttaattaagcttttgcttatctctccctaccctatataatggaagcctctttctttttgattttgtgacacttgacaatttctgaggttggagcattctctctgtggcaatggtctttcttttgaataaaatccctccttatctaagtctggatttgttttcatttgacagaatacatagaagagaaatctaacttgggtgggaagaggaggggatgaagattagagaaggcttcctggaaataaactgtgaacagaaagaaaataaaacattggctgggcacggtggcccacgcctataatcccagcacttcaggaggccaaggcaggtggatctcttgaggccaggagtttgagatgagcctgggtaacgtggtgaaatcttgtctctactaaaaaatagtaataatacaaaaagctagctgggtgtggtggtgcatgactgtaatcttagctacttgggaggctaaggcatgagaatcacttgaacccaggaagcggatattgcagtgagccaaggttgtgccactgcactacagcctgggtgacagagtgagactctgtctcagggggaaaagaaaaaagaaggaaaagaaaatgttaaccaaactaacacagaggacatgcacggattccaggctgtgaggtggcatgcgtgactctcttgccatgtggcagtatgttcaggtcctcaccaacaccaccatctctgatctgtgctccataagcctgaatggaattcttcatgccacctgcacctggcaatgctcccaaacaactgcacctggcaagctggcctagctccttcctcggtccaggcctagccttctgtgtgtgcccacaaaaacacatgcacacatgttctttcttattcaaatgtgtgacccctaccctcagcatgccacagacacctcaagtgaactctagcatctccagaacacccaaggggtcaagtagttattatgatagatgtaggccatctctaccttttcatggactctctgttcatggcatctcactctgtaggcttaggcaaaattcctgtagcctagagagatctgagactacaaggacatgaaaaatgcaaagagggtaagcttgactggaaactgcacaaggactggaagcaggtctgactcattcagcatcatatccctaccacctagaacaaggccccaacacacagtaggggctcaaatatttgttaaataaaatgtcatatcagctcacgtgaataattccatctatcgcagagtttcctctgacactatcatcaagcaacattttaaaggggaaaacagtggttgtcctccatgatatgaaacacacaaggctagcaatgcattctgaacaaccctatttcccttaatagcccgttatgcacatgccagccatgattcatgatgtaaatgtaactctagagtcgtatgaccataagtaccaatgccttggaagtgtatctgagctgctacaagagagattatttttttcctcactgctacaactgccagaaaatatgtttaaatcattacttgaaattcctttcccaaccaaatctcttcccagagctgttaacaagaaacaaaatatgctgacttgagtttcactttctttccattcctctgccttcctcttgtgggacccccaatgaatcatgaaatggttttggtcaggtaagagtgaaaaaagcacagaacaaagcccagtctgtcaaacatgcagatcctagaggacagagactctgcagcccagttctaccaacggacgtaacccctgaaataatttgcacctatttcaatcaactattcatctgctagccttctgattttattatattatgaagccatttattttcaaggaaactatatttgttgcttagttgatacatgatgaagtaaactgagaaaatacactcctaattctcaggccaactcttttaaggcctataaaaaatgacataaatagattctgatgttgcttcatttctgcagaagggtgtttttatattatgttcttctatcaacacagtaagtacagattgcatcttaaagctctcatctagtgctggagtttccaaacacaatggctttaacaaggaaatgactttggaaaggaaaataaaagaatgtgatttctttggggctgagcatgggagagaagcacacttcctgtcatgacttgggaggcatgcagagaccagctggcaaggctctgatcacagaagctaatccctcaggagaaaatgggtaatcccagggccaaaattcacccaaagaaccagaacaaatatgggcttgggtcagacagaacttcattaatcagggctcaatccggcagccatgactggggagatgccatgtaaagaggaaagcagagattgaagtgatgcttctacttgccaaggaatgccaaatatcaccagcaaaccacaagaagcaaggacagaggctggaagagattcctcctcacagcctcaagaggatccaagcctgctgacaccttgatctcaggtttctggctcccaaactgtggaggccaattctgttattcaagccacccagtttatgggactttgttacagcagccctagcaaactaatacagttggcaataggagttaggtagcaggaaaataataaataactgaaaacagggaccacacagttcatgtgaagctcctggcccttttcaagcatttgtacgggaatctctgggaaagagattcaaactatcacttgaggctaaattcctttatacttgggaattcacatttattcatttgtatgacactaaaagaacatgagaaatataaagacaacaagctagagggggtcagggccccatacaatagccaggattctgctcaatggcttcatgcatagtcaaaccttaccagctgtgtgagaataaaggcagaagaggagacccttcaacccagtcaggtaaagttgacaaggaataggtagtatgtcatggtccaaaaccaggaggccagaatacagggatgggtccatctccaaggatctgaagtgtaagtcaaatgtctggtgggacatcactgtgagtttgcagtgacagagaggggctcagggttcaccccaggacaaccatacacagggtccatcatgacaaaaccattccaaaccctggcaacttgtgggttgatgctgggtggaagctgttggccctggctaagacccaggaactgaacaaaattaaaattgctgccaagggcatgggtgatgctgggtaggggtgatcatggaaagcagggactaatagtgtcaggtaaagccacacactgattgcatgtaagagaatacatgacagtaatcatcaatagaggaagaaataagaaccgtcaaacactagatattttacacatattaaacatttctcatatattacattacaaagttggcataatattctacattcaactttttgcattctttatttccttaggaaactgtgtttctactcaagttgtctgaattaatttaactcatatgccactgtgtacttcctttgagtttggggtccatagctgtcctgctccactgtctcatgccaggtcttttcattacatgaactgcaggatgctctctctcaggcacagtgttttgggggcaatgcctctaaatgatgcctccattgaggcaaagatcacatgaatttgtaattgtttgcatctccacctcctctgaaacacagtgacctgctggaaagcaaagaccatgatttgtctctgtatcctcaaagcccagcacaagtatcacctgacacatgcactataaatgctcactgaattgattcattcttaagaagattcaaaatgaaaaaggaagcaagcagatttggtgagccatttctgactggtatttcatgaattcatgtatttaactatgggccagcactatgtcaggtaatacattagtcatgtgaagaaacaataagattgatcactgctaaggtatagagcaagtttcaggaatgcaagaatgggctgcccttaattgagcacttagcctctctgctgccttttgctcattgagcaaattggatatatattcaggccagtaagaacactcataggctacctgctggtgtagatgggctccttacaagatacaaattgaggctgggtgtggtggttcatgcctgcaatgccagcactttgggaggccaaggcagatgaatcacttgaggtcaggagttcaagaccagtctggccaacatggtgaaaccctatctctactaaaaatacaaaaaccagccaggcatgggagcatgcacctgtaattccagctactcgggagactgaggtaggagaatcgcttgaacccaggaggcagagggtgcaatgagccaagatcatgccactgcacttcagcctgagtgacagagtgagactgggtctaaaaaaaaaaaaaaatacaaattgaccattgttgaacactagccatgagccacacattgttatgtatgatctcacccaattcttatacaattgttatccccactctacacatgaataaattggggcacaacatgattaagtaagttacccagatccctttgctacaatatgacaaatctggaacataaacccagccagtgagaagttcttaaccactccccagtgctgcctaagagattagggttggatgaacctacagattataggttttggtatttgctagcaataaaaacttgaactctaagtgacttaacattacagtaacccccgaaggttcccatgcgttatcaaagataatgcataaggcatggttggaagcagctctgccctttggttcccagaggctgagcaaaccttacccccagactcacattactaacacaactaggaatctggtgacaatggtcattcaacagaaattcatgaagagcctgttacatgccaggtactatactggatattgggggatctttccactaagaaaaaacacatgctgatagaaaagattgacagagaaatcagcactacaatcagagtggcaagtggtaccacagagttaagcgcagggaccctggaagcacattgctaaggatgaggcaagataccccaaacttgtcctcaaatctcaacccttttaaagtggcaactgaatggtcacattcaagtagaagcaactgttaggtgacatggcaaataatattcaataaccaaggatgacaaaaacaggacagggtagaatacttagcccagaagtgggtggatggcattgagaactggaaaagagaggggaggtggtcaggagtcattcgaaagcttcctctctggtcttccatgtagaatcttagccacatatagttaagattgaaggtaattaacaaatcaagcaaaaaccctctgctatttcaaatatcctgcacaccaggcaacatacctaccatctttatgataatatacagctttgttatgccttttgggggaaaatctgtattatccccattcctttcactagtaatacctgatattaagtagcacttttgagtttataaagaacattcacaagaattatatcattgaattattactgagcagacagggcatccattttacagacaaggaaattaattctcagagaagcttgttaacaaaatctcataattgaaaaagagggatttaaagaagtgcttttgactccaaggttggttctactgcatcaaactgccattgtttactaaaaacttaactacagcattagaatcataggttttaaagcacttatttgaatgctgtttgctgtttcatattaacagcagctgttgctacttggcagttactaagccctaaatattaggaatggctggggtgaagaacagctttgaaatgacactatatttgatcagcttctgcaataactgttaaaatcatatgcatgtcctttggatccctataaagcttctacagtatcactgtacctgcagttccaatttgcaatttcctcagccctcctttgaagttattcttgccaattacctggtgttaatattaattaaatatgatttgtaactcaaaatgtggtgttatcaatggaactcagctgtacaaatataaagtaaaattttcaattgaattaaattgtttcctttcattcatagtattttacaacattaatacttttctcaaattgacttttgcctgctggaagtcattttcccaaagcaatgaacatctgaggggaaacactgctgtttatgtattctttcctttctgtcattgaaaatacttcgttttaatcttaaagtgaatccatttcagttaccagaaacttgcttcttgtttataacccaagaggggaaaatgctttattttaaaactgtactaagatacattaaaaatatgatcagtgaacacgtttcaattgtacactagggatgaaactttccttaccttattgcttgaccctcacaaaaaaaaaactatcaaactttttggcaactgtcattttatatacacaaaaaatgaattaattaaattggtttcttacattaacatttcaaacagaatctgccatcccaacaactctctggtcccttccaactctaagatgttaatattcggaacatgtcaaacaatagtcagaagcttccagcatttgcaaatttagggggagaaagacacacatagaatatttgacagaatcaggtctattctgccccctgtaatgtatgcaatgatgacttgaaggcctgtcatcttcaataagccattcataaacatgatgactgattaaagaaggtgtgctgccatactgtgcaaatctacaatgaaaagatatgttctctcatattccttttatcttcaaagataaagctttagcttccttgccccttataatgatagcagtagcattaacatttattatcctgtcttcttttaaaaataatataataatgtaagacaaagaagggaaggaacctgtctaaagactaaaggaagtcatttattgagtcatgagccaccaggcccagagcttatgatggaaaagcatgagtgaatattattaactcctttattataatgtcaatgaaacattatatcaaggaattaaaacaagacagaaatagaggactgtggatctaatagctgagtgttgtgtaacacgtaggtcttaaccagcagcaactaagctattcccttccctcaggccaaaagaccaaaaggggaaataaaaataaattaggccagaaaaaaatctctggatgtctgtcatattccaggtgtcatcaaagagaagcttcttggaattacaaagtggggcaggtgaacagcaggtacacacctatgttggcagtgtctattgtgatcctactgggagctctacctaggaaagccagacagacactgggatcccatcacttaccccagtctggaaccctgaattatccattaggttacctcatttacccaagaatcaggattgggagagtagaattccataacattccaaaaggaatttgtgaactcgctatattacaggcttctccattaaccaaattctgtctgcttaagcccttctcattcttattactaacctgttgtcctcctagcccaaatcccatccctaccactggaagctaaccttctgagtatacccttcttcaccctctgttaagaactgaattatctcccaagaaaaatacattgaaatcctaaacccagtacctcagaatgtgaccttatttggaaagagggtcattgcaaatgtagttagttaagatgaggtcatactggggtagagtgggcctttattccaatatatcttcatttttataagaagagaagacacagagataaacacaagaagatggtcatgtgatggtagaggcagagactggagtgatgcatctacaagccaaggaataccagggattgtcagcaaacaccagaagctaatagaggcaaggagggattctctcctacaaatttcagaagcaaccaccttaattttttatttctagtctccagaactgtgagatgataaatttctattattttaagccactagtatactatattttactataaaatgcctcctttcaaggacctctcttcatgtaggaaccctagccctaaccccaaccctactgtgcacgttcagctatgcattctggcaaaagttcctgttttcttatgaaacactgctcatcatccttaaatttttttctgaggatctccttttatcatctcccataattgaagtcttcttcaaaggagactgagagccctcccatgaccataaacccatgaaaagagaacactctaccatactgttacctcccattgcaatgtctaggccattattcccacactgtattcatctgttctcacaatgctaacaaagatatacccaagactgagtaatttgtaaaggaaacaggtttaactgattcacagttccacatggctgggggtggcctcaaatcatagtggaaggcaaatgagggacaaagtcacgtcttacatggtggcaggcaagaatgcttgtgcaggggaactcccatttattaaaccatcagacctcatgagtcttattcattaccatgagaacagtatgagggaaaccactcccatgattcaatgatctccaccttgccctacacttgacacacggggattattataatttaaggtgaggtttgagtggggacacagaaaaaccatatcacatacctttatatgaaagcttctccccatgagtccatcctcattcccctatacttctcaccttagcaaccacctttccatactcaaccatcaattgtatgagaatgagctttgatctatatctcagttcctgcttggctctagatcaatgttccttgctattcttctccacaaagctatgtactggtacctaaagtttactgtgttcattttactgtctcttttctgtttatggtacctgccttttcctagttgcccaggtatgcaatttcaagttcaactttaatttctttcataccctcaagctctgtgtcccgttactaaattccatagacttcacctcacaaatgacccccaagtctatctcctcttccatttatattatcactgccctatatcaggccaagattgttattgcaatggacgctgaactggtctccttgtcttctacttcttatagtacaaccttaaatatacattctgatagatccccctctcctcagcagtttcctcctgatataatatgagtatttgtccctgccaaaatctcatgtgcaattgtaatccccaatgctgaaggtggggcctggtgagaggtattgggtcatgggggcaaagccctcatggcttggtgctatcttcaggatggtgagttcccacaagatctggttgcttaaatatgtgttgcatctcccccattcccaactctctcttgctcttgctttcactatgtggtgtgcttgctcctgctttaccttctgtgatgattgtaagcctcaaaaggcctccccaggagcagatgttgctatgcttcctgtacagcctgcagaaccataagccaattaaacctcttttctcataaattacccagtcttgggtatttctttatagaaatgcaagaacagcctaacacagaagattggtgctgaggggtggggcattgctataaagatacctgaaaatgtggaagtgactttggaactgggtaacaggcagaggctagaagagtttggagggctcagaagaagacaggaagatgagggaaactttgtaccttcttagagaccagttaaatgcttttcaccaaaatgttaatagtgatatggacagtgaaatcctggctgctgaggtctcagatggaaatgagggacttactggaatctggagcaaaggttacctgtgttatgccttagcaaataacttggatgcactatgtccatgccttaggactctgtggaagtttgaacttgaaagtaatgacctagggtatacagcagaagaaatttctatgcagcaaagcattcaaaatgtggcctggctgcttttaataacctatatcagatgtgggagcaaaggaatgacttaaagctgcaacttatatttaaaagggaagcagggtataaaagtttggaaaatttatatcctagccatggggcagagaaagaaaaagctttttcaggagaagaatttaagcaggctgtggagcaaccacttgctagagatatttgcataactaaaaagagccaagtcctaatatctaagacaatgggggaaagtcctccatggcatttcaaagacctccatagctgtccctcctatcacagccataggagggaagagtcctttcatgggccaggtccagggccccactgccctgtgcagcctcaggacactgttacccacatcccagccactctagctctagccttggctcagagggccccagatattgctcatgccactgctctggagagtatgagctactataagccttgacagcctccatatggcattaagcctgcaagtgcacagagtgaaagagtgatgaggcttggcaccctctccctacatttcagaggatgtatggaaaagcctgggcacccaggaagaagcctgctgatggggcagagccatcacagaaaacctctacaagggcagtgtcagggggaaatgtggggttggagcccccacacagagtccccagtgggggcactgccaaatggagctgttagaaagaggccaccatcctccagactccagaatagtagatccaccagcagcttgaacccaggttgaagtgcattggtggaatctcggctcactgcaacctccacctcccaggttcaagcaattctcctgcctcagcctcccaagtagctgggacagcaggcacatgccaccatgcccagctaatttttgcatttttagtagaaactgggtttcaccatgttggccaggctggtctcaaactccacctcagccccccaaagtgctgggattacaggcatgagccatcacaccaagtctggacttttgagttaatgctacaatgagttaacatttggggagactattgcaatggaaaaggacatgagatttgagaggagccaaggtggaatgatatagtttggatatttatccccacccaaatctcatgtcgaaatgtcatccccagtgatggaggcagggcctggtggaaggtgtttgggtcatgggggcagatctctcattgcttggtgctgtcttcaagatagtgagttctcacaaaatctgttcatttaaaagtgtgttgcacctcctccccttgctcctgcttcaccttctgccatgattgtaggcctcctgaggcctccccagtagtggatgccactttgcttcctgtacagcccatagaaccatgagccaataaataaacctcttttctcataaattactcactttcagggatttctttatagcaaagcaggaatggtctaacacacctccattgtctagaaaactaaggataaaataaacaccctatgatttgaaataatcatgtgtctatgtcaaaccttccaattttgtctcccataattcactaaacaaactatgctccagtcagaaaaactgtgctatttgctgataccaaatatgtttttttccttctccagcaataatcctatagtcaagagatgccttgggatgacactataacagctgggatatcaaggggctatttgtctttaccaagtgtctcctggccctctcccactcagaaagatctcaactagggaagagccatcactgaggtctgatcaatgaccaccatacactcataaacttcattctcccagattcgcaaaggacactttcccaagtctgatttttttaaaatgaaaaacattctaatcaaactgtacaagcaatttatcactaacccaattttcatttcaccatcattccattatgatctgcttgagttaatcagaggtaagacagaggaagcctcaatttacactgaaacttcttagcaatcgatgttgctaaagagaaattcagaacaaagtacagaaaacattatgagttggggaaatatacaattttattaatgggcagacactccaaaaaaattgaatgtatacatctctttctcactcaagctactgaggtttttttttaaaaacacactactaacatggtgacagatgtcatcaatgttgtagtaagagctgcaaatgttacagaactaatgaattttcattagagacatcagataatttcagaatgggttaagttgctaccatttgccattcccattaacatcattgtcatgtaaaaggtttaattttcagctatttttgttctagataaaatctttgtcattaaaatgagggatgattttgatatttaatatattccatggcatactccagtgtggtactaatttggccttttcagtattctgcatattaattaacaatccatccctcctccattccccagataagtgagaactgaaatagaatggacaaccaatcaagtcacagaatactgaaaagatcaacacagaagaaatgtgttgctctaatcaagagcatatacaaggcaccaaaattattttctcccatgctaatgactatgatagaaacaggagtaatgaatggcaccatctaaatccttttatgtgacagtattaccaaagcacagcaatgctccctaaaaaataaaaactaagtatttcttattttagtcaaaagaataaaactgtggtttcacttaacttttagaacaatccattttgttggattctgcaacaaatggcagattatgtcctgttttgaattttttatagtaatctatctcatgcacacaaaatgtgtcctcaagttgcagaatgtccaggatcactgtggaaaacttatttcaatacatactctattagttttctcctcttgctaaattatcactctggtaagaactgacatcagctgcttaaataatacattaaccctgtttccagaagctattgttttcatttgagtgggcatttcctctaaggataaactttagatttttacccaagaagataatataatttgtcataatttaaagaccaattgaatgttttgaatcagttttatagcagtaatgatataaattcccagagagcaaagattatggcataatgcacacttacagcaggtgtgaacagttgtccaattaaatcaattagcccaatctgtccaacaagaccaggcctttcatacattttctgcaatagcacaaatgtagaacaaatgttaaagatactaaatattgtgtattataatttttctatgtcctactatgtacagaaaagcttgcagtcatctgcaagtctctcaagtgaacatcctacttcaataacatcagactttttgtccttggtaattatggttaagcccaaatcattcccatgatctttctctgagtcgaggcctctaagaaaaacaataaatttatcaacataatgtcttccttcaggctcaaaattactgaaaaaaatcaatggacactttaatttttccacaaaatattactcttatagaaaaattcattcattcttaataagaataatagtacttaagtaacaacaacatacttaattcacaaagatatgttgttgacaaatcagcagttaagatttgtgctctaagttgttcctttgttttgctctgtgttttcaaagtagtggaatggatttacaacctcatcgtacacatacaagatggtaaaatgcctagacacttggataagcaccttgaaaaaaatgcccaggacagacatcagcagcaccttgttgtaaacaagtttttacatcttgtccttcatcacaccctaagcttcagagttttaagaataaaaacgcaaaaagtcaaatatgacaataagaatattgcttaagtatagccttgagggctacttcagcattgttttaagatgattactagacttagtccctctagtgttggatgttaaattccactgactttttttaaatttaatgacttgctaatgtaaacttccatctagaacaatcaaatagtatgtcatttattcaaatttacagtggctctaatgtgccagcaaactcccttgtcaaaacagacaactttaaaaaatgttcatttgagtcaggagtcctacttcctaaattagcaccaaagtgtcaccttgatagacctatgaacaacaaaatcatttataataaacccagcttccctctagagtggacagcctagttcatgcatctgtaggagttccaattattccctacagataagagagcacttggagatgctcaggcatcagcaatctgtcacctccaaatacaatcatctgataaatatatgcttaccaatctccctcgagatctgggtgaaggcctccacaccgctctcaccatagttcccctcagaagccagtgtcgaaacataattccatcccagtgctgtcacgatgtccaccatggcttgggcttggtaggagtcaggcggaaccactcgagagaaaaagtcatacctggtgttatcacttagctctggggctgtggatgcatagctgatttgaggtatctgcaaaacaaatgatgggtcatttcaacccatgacgaatcttgaagaatgatggattgtcatatgagctaaacagccaaggctataccagaaacctagacatatcaacctgaagccaaaatacagttttatgactaccaatttaattggaaagtatttttgaatggcccataggcttactttctctcaatgcacaatatttctaaacagtgagaaagaatttcattttgctttagtttccattgtttctggagccaaagcaaaacatttgtgctttttgttgatgttgctttttgttgatgttgcttttttagtctgtacatgataagctctggtgcagaaaggagagaaaaatgaaggcatatacatcagaaaaggtcacctctgaaactggctttggctttataggacataaatgctatacaatgactaacagggaatttaatataagatttttttatacttgataccatttcagtcttaagactatatttttagtaaattattgtaaatatatagttttgcaagtctattgactgtttattgatataatcagagtgccacaaaaagatttgagaattgccagcagccacatatcctctcatagaaacatcattctaacccccttcaaaacatcacagaaaagggaatccagaccataaattctttagaagagactatttttcttttaatggggtgaattgccagaaattctttgaaatgaggaatcctatgtcatttctcaataatgtgggagagtgagctatgtgattgtgtatagtaactcctctgctgccatgctgtggtatgagtgaaagttcagagatcaaagtgactccaagatgccctaattcaggtaacttgaagatgcaggtttgacttgtacatgaaaaaattaactttatgctacatcacatgttgcagctaatgtcagtgctcaaagaggatgtcggagttgcagttccatctttccccacagggctgcacactctgggatccaatagtccccactacagtgtagacagatgattcccaatctatataaacatttcaactccacccttgacatacttgtaaagctctcaacatctaaataaccttcctaagtctagagagtcctgttccctactagtggccagtgaaatgacagtgaagttcctaaaacgtaaaagtcatcccgggagcagcagcagagcaatgtgcttggagctgtccatggtgctgactattcattcagcttccatgtaacttggatccacctgcattggccgtaacagagagtacccagaatagcgtggcccatttaaccccaaattctttctggttctgttctcctagtggggactgtgttaacttatttgttaacactgtgggaccatgaaaaccatctgacccacctcctcctgccctttgccttctctgccagatatactgaccttaccttgacaaatttttcccctggttagattttgtgactgcatagtacatgactactcgcaaggacacccctccaaatctcaaaccacacaccaaatcttgccctttctcaccttttcttgtttgttttcagaggacctgggaaggaaaccatggataacttagtgagatctacctcttactaggtaaaaatttcccaaatatcaaaagtatgtgcattcctatatcctaacgaaaataagtcagccatctgactttcactttagaagaaattatatgtatgtgcgagtaggggttgtgtggggggaagggaataggggagcattctatagcaaaatatatagccctacaccatttctttgtcctatttggataccgatactcccacttcctgagctactaagagtccagcagtaaaatgacttacacaactcccaccctgcctataataatgagccaccctttctaaaaatgagcagaaagtgtgaaaattgagtgtttgaaaccaaaactaattatctcaaattactaccttcagtcagtcacttccaggctgtttaattagcagtcagcctcatgtttaggattaattaaacaggtgtaaagggtatataaaataaaagtgcagatagaagatggttgtttgattaattcagtaatggactttctccccaaagtcttgaagagttttctctttgcagatcaatgtgtgggaaagcaatgcaagagtatgcatttgtatttttattttttcactctacaataatacacatcagggtatatgaatagtatttcaagacaagttttcaagttttcatgaagtcacatctcatttttattttattgtggtagacccctaagcattggttcattaagcattttaatttctgtcccagcatccccagtatttctaccacccgcaaattaaaccctactggcaactgaagtaaaaattttttaaagacctggaatgttccttttattttccctacatcaaattcactgcaactacccacttaaccttggaggtttcatctaccagaaacacagcaatggaaaaaaaggtggtgaatggtgaagagaagcggaggaaaaaaatgaaaggaaaaagaagaaaagcatcccaagaaaagaagttgctaggaaaagcacccattatcagttcccccatcctttaaaaaaaaaagtagtgtcttttataagcctctgttaactcccatggccaatgtaaaggataaaatacaaactcttcggtctggttcacaaagatcatcagattctgtctcatcttcctcccctgacctgtaccttctctccatattctcacagcatctgcacccttctccataccagggagatttaatgctctcctctatctaatgatcctctatacaaattcaatatccagctcaaaagtcacctccatctggggacagttcactaactccatcaggcagagctgtcttttgctattcctgtcttccaaagcctccgccatctaacattagaatcatgactctgctggcttatgatcctctcaagaccaagcagggtctctgtttctttatttggcatccccaacaccaggcagaccaagtgctcaatgaatgtttgagggcaattaattaattaaactgctgcaggaaatttaatacagcttcttccccaccacctcctcccttgcattccaccaaaatattgtgcaggctattctccattcgaccctcctgatccttccctatcctgccaaagaccctaggaggctgctctctatgaccatactgcctgggcttccttgcctctggcttctagttgagtttgtcccggaggcactagcagaacatgggagggcgaggggcgacagaaagaagttagagtatttatcccacagtttctttttccactggctctgtttctccacctaacccctcacccacagctaaagcttttgccagattccagtgaccactctgtaccattgcccctgtaaggtctccccactgctgttggctccgaagcacttcatcatcccttgttttttctaactgtgcccacacttacaaataatctttttgtgaactgccctttcattacccctgggtgtgccagaagcctgatgaacactcccctatgacaagtctctgtagaagacaacactgctgtggctccccaatctcagccctgccctaacttcttagcccttctctagccacctgcccttccagccttctctaccactgtccctaggtgactttctcatttcctttcttcttcatttccctaaggcatcctactgcatatttgaaaacacctgtcattttgctttccttcatttcttattttctttgtgctgagacttcataaaaatatcatatgtgcttaaataaggccatatttctattactcaaatgaagcgtatttgagtcaattaattatacaactcaggacactcatcatcctctttttttaaaaaaaaattgttttggattccacttttctaacaattattttggttaggaaaaacgctttttcttctctcactatattctcacttcagcccacagaagaggagattcctacctcccaactccattctctttgggagctccagaacaaacatttcctctctcactctccgttcctttactgactttccccaacatggagggggaaagaaatcaaagccagagttctacgtttattgggcaaaaggggatagcaggctctctctttattctctgacctgtccacatacatctcaggcttcttttctctataatgtcatgagaccatgctgggcctcaattcttggaaaggaagcccaccctcttctctccatattccactggcaaccagacatttgagaaatacttgaagtccatgctactcactgcaagtgaactttaagtcttccgtgcaggcagaagtgggtcccaaggttgagatatggtgcaagagtaggaggcacaggttcaagctgaattatctcgaacgcagttcttagcagatagtcatgtgcctggggagttatttggtgcttgcccagatgttaataaagctaattacttaatctacatttaactagctattctgtgaatattggacttgcaaactctgagaaattccaaaaatttaacttagagctcaagattaaaattatatttcaaaagaaattcatttacatatattattaataggagttagcagagattattgtcttctagtgtctgttctccttctagatgaaacctccagtttttacctaaccacccagaacgtgactacatttcctggccttccttgaaatggtaagtgaagcttctgaaaaggatccttaaagggagaaggcatgcctttttcatgatcctccctctttcttgctggctagaatttggacataatgcctggaactccattagccatcttaggctatgacctagcaatggtggagcaaaaagccacaccctagtccaagccactgtgatatctggattcctaaagccacttgacttttcttcatgcttccattcatgctcttctcaaatctatgccacaccagcaagaaaactggtattttacaaaaacagatcttaaaggctgggtgcggtgtctcacgcctgtaatcccagcagtttgggaggctgaggtgggcagatcacctgaggtcaggagttcgagaccagcctggtcaacacggtgaagccccatcactactaaaaataccaaaacttagccaggcatagtggtgggcacctgtaatcccagctactcaggaggctgagacaagagaatcacttgaacccgagaggcagaggttgcagggagccgaaatcacaccattgcaatcctgggcaccaagagcaaaactctgtctcaaaaaaaaaaaacacaaaatagatcttagaaaaatcttgtttagagtccttcaatcatttccccattgcccttagaatatagcccagacctcctgtcacaggatcctttgaactggcaactgaccacctatccctctcactcacctgatccaactacactggcttcctttttgtttcacctgcagcactcatacatatcaccacaaacattttcccaagtaagtccttcctggcctttctcatccttcagcctcagctcaacagaccttccctgaccaccccatctagtgttgtctcctcaccttccattatgacctcatcactctacttatttccttcctctttcaccacctgcattaatttgtgtattctgtttcccctactaacatgtagattccacagggttattttctgcattgttcacagatgtaacatgagctcccatgagatagtaggtgttcaataaatattcattgaaagtaaaatgagcccatccatccattaatcaagaaccccttttgttattttcttccatgtatcctaactttgaaatatttttctataaaactatttaagttaaaacaccacccatttccaatattctcttttaatcaaagatctgttcagctgcaaaacttctgatcagcacaaggcatctgtttttaccaagctgaagtgatggaattccagttcaaatcaccgaagtgccgcttcagttgtagcctgtgcagtcttctcgtagggaagcttacaactgccactttgctttttgaaatgccaaaaatggccatgaaaacttcataactaccttggcaaacaccttgacagcccacggacttcaatgtgtcattaaagaataaaaattacatttctaatcaaaggtcaacatcatagattatttaatcatttaccccttctttcttatctttatctgtaagatagatattccagacagggaaaaaagtgcttacatctcccccaaaccaactgtgtctctccatgttgccttcactgagccttcctgtacatgactgagtgatgaaataaagggtctctgaggctccaaggggatcagagacttttagataccagaaatactttttgtggcccaaggaagaacaacttcagctgcctcaaggtttcccactgcttgcacatcaaaacattgcaataagcttgaaacttgccttgtctattcagaatgccataagtttttcatctgttcaccacagttactggtttgctaaatatcccaaggaagccaagacacccctgacaaggctagcaaaaagccacctaaagcacagcttagaggaagctcctccaaattctaggaaatttcaatctttctgcaagaaacttgcatacatctgagtacagatttgcagacagaagacaatttaagacctgaatcacgtatattttcaccatgaaaaagggtttttttttgtttttttcccccctgccaaaaaaggtttttgttctctgcaaacaaccttgtccattgatcatggaacttaattggtgaagtaggttggcggggtgggttctttgtgctactcaataacatcattggttttttccagtgaaagatcagcttgaagccacattcttcccttagggggtagtgcttgaccaagcacttttccagtgatggtggttagcaacagcggccatcaggatgatagcttcctaccacctggccttggggtagatttgtttttgctgcaaaactcaggtcaaaaaaaagcataattattatagccattaactttgtctttttatatacttgactgctctctagtattaaaactactagttgcttgtggcaaaacatcagtatataatcagaaattagatataaatgaggagttagggctagaagtcaatgtccagcactggcccaactctcccgacactgccctgagctttcatgctcctcccaccttcatgaaaacaggctaaggagagggaaaagaagaaaggaaatgtaaagccagagtgtgaaacaaaaaagaagatggatgactaccccaagtttgcatccaaaaacatgaagtagtagtattccttccccaaatcaggactggctcagaataatcctgtcctcatagtcgacagttattaagattcctgtttgtacaagttggtgtcaaataggaaattcagtctctgaccttttcttctcagttgagttcccatagttgattcagagcaggatgtgagcctttgggttttgatgcacaatggagtttaacaaaagcaaaggagaggaagcctattgaaatggggaaatcatggggtcaaggagagccaggagtacactatattgcaccatatttttatctatctccccaacatgagctcagtaagaccaagcaaagctttacatacacacctgcacaaaaggggcctgtggttagttaacacagctgagtgtaacacagttagtaggtttaaggtcatgagttgaattccattatgggccaggatgaagaccacacccctcaccagaatcttcctctcacaaacacagagcacataacaaagtcaaccagagagaggagagacaagatcaatccattctcactgctagatgaataattcaaagatggtttgctactaatggtgaacctaaaattttagcagcaaatcatgagacacactttcttcaaaacatagtgtttttgtatctatatctgcctgaaagtataaatatatattacacttacaaagtcatatgttgatttcagataattcatttgaatagaccattgaattgtaaaagggtacattttctcacctccttttcatgggtattgtatgagtcatagagggaaagaaaacaaatgactcaaggagactaaataaagggactattttcaaggcaggagcagcatatagagaaggcagtggaaagccacaacctagaaggagtcagaggtcgaggttggcagttgttacccatgagccctaagagagagagcagttacagagtcatgaacggaagccaccttgaggggtgcagtaatctctctaaaaggacacagccagcccctggcaacctcaaaaggaaattgcattctgacctctccctcatacacacctcctgctgggtctccctctgaccaaatctattggaagccagagagcaagagaacttgactttgcctgcacaaaggaaccttccacggcagccagcagacagcaaaagaaagtggttgtggcaggccaagcagaagctatctagcccaggcaccattaatcattgctcactggacatgtgaactaaatgtatggagagctgtgcagattttcagttttctacattatattactctttcataatttgatgctttcaaatatttttgacagaaaatctacactaagacattttgatttggctactgaaaatcccaatcctaagattagactaatgaagtctggatttcttatggaaaataaaataactaatatcatgttttagaaagaaatgtaatgattttaatcaaattggtaatggcattttgacttctaacctgtttacttaaaataaaagagaagcaatctatgaacatgaaataatttacatataagcaaccataattttaccccataagattaataaaccttttttttttacatctgctaattacattttacaataagaaagcacaacagctccttaggaaaagaattgttctaatccatcaagtcactagtagtgtggggatttttaagcctaactaccctaaaagttttactagcaagttggatttaaaaccttcactttcaaagaaagggactttaggctgggcccagtggctttcatctgtaatcacagccttttgagaggctgaggctgtaggatcccttaaggccaggagtttgagaccatcctgggcaacacagtgagacctccatctctataaaacattaaaaaatttgccaggcatggtggtgcacctgtagccccagctacttggcaggccgaggctgcaagatcacttgagcccaggaattctaggtgacaatgagctataattgcaccactgtattccagcctgggtgacagagaaagacactgccactcaaaaaattaaaaagaggactttaatattccaactaattttatagtttctctagtttatagcatctccttatcttcaattttgcctttttaaaaaattgaacagttttatttaaatttccatatatttcagtactctgtgattctaaaaaattataatcagtgcatatgcaaaattacacagaaatttagaaggctaaaccaatacatacacttcttctaatagttaaatgttctttaatggttacttttttattaattcattcaacaaattagctcccactacatgccagacacggtgacaggccctggagacaggactgtaaacaacacatggtcctcccagccccatggaacatatgaccaaatggaaaaagcaggcattcaataaataatcaaccaaataaacatttaacggcaattgtaatggttgttgtgaaagctatgaacctgccgctaagagttacagggccactcacctggtccgcaagggacagggcaagcttccctgatgaagtgacattaagttgacacattgaaaaatgaagaagaaaaaggaatgaacactgaacaccagccacagattgcctctcacttgagatctccttcagatgtgtatactacccaatttgcagaaatgaagaggacaggcagtctactgacaggtacttaattttagaaaacttgccacaggctgaaaaatattaaaccatagaccaccgtctcccatgcatattacaaataatgttttcaaatactatatgcaaaactggggttcttatgccaggactatcaagaaaatgctacgtaatttatcagcagggacttgcattacattctcacagatctctgagtcctgaggcttgtaagggtaaggcatgaataaatgaatggatagatgaaaggtaaacagatgaatgaaaactgaagacactaagaagcaactttaagtcaagagtccagaaaaaaaataaatgtatacttatattacttataagctctaatatttgtttccttccttaggaaagtaaaaaataagtgattgaaaagtaggaggaaactctcttctttgtactcaggcagtgaaggctttgggataggacttcaagctatatgagaagcaggttagaactaattctaaaagaacctggctttgctttgctttgctttggtttgtttctttacaaggtaatatatattttctgcacctctcaagaggaggaaagagaaatacatgcatctgtccacccctggaaactctgctcaatgaggcagcatcccagggagacatggagaactgcattccctgatttcattctttctgtttctgccagtttctttgatatcttcttggaaaagttttcaagcagtttgggatttcaagatgaaatctctgattattcttcaaaagaaaaattaggggaagttttgaaatgagctgcttaagacagtgaaagttttctataaagtgattttcttacatgagtacaaaaaataataaattacattgtgttataatagaaaaaccaaaacgatgccatggcactttattagcatcatttgctaagttacttaaaaatttaactctcccacccactcattcccatcactgctgacttcaaactatcacctagcatttaattttcctcttctgctgatttccttactgtgcaatcactgctgtggttcaatttttcccccaagcatgtcagcactagaacattataaaataaaaagtcagtaattataactaacaaattgaagtcaataaactttaagctggcaaatattcgatttagactggcattctgccagccaatagtacatgatttgactcctgcaaataaagaagaatgttgataaggacgtttatgcaagtaagtttcctggctggcaatttcatggatttttagtgattatccgcattcacaaaatcttagtcttcaagtcattatttatctcccagctagcattcaggtactgattctgaacacctaatagcactggaaattctcatttactttctgttacctaagttagtaaacttagtagattagaagaaggtacgcatgaggttaaacgtcttcattcgagctccatttacacagggggaaaacccactccatttgcaaagaccaaaaagctgatttcataaatggacatcattggtaacaggaaaagttgataaaaggatgtaaatgactcagagtcctttattccactacatactacagaatgcaaggatatgttcctctgagaaggcatcatctcagtatccaaagggcaatacattaagtttcccctaaacaaattgattagccctttcatcctatgaacatttttgggaagcctagcttactgctctctataagccttctttatgtgtcgtattccataatgtgtgcgtatgtgtgtgtgcgtacacatgtgtacatgttcattttgccaacatttatttaacatgttatattggccaagaactgtgcttagtgctctagcttcatttcatgaatgactaaaccataatctggagaagtaacttgcccaagaccaagtaatttgtaaatgacagaataagattcaaatccaggtagtctgaccccggattcatttcttaaactcctctactctccgctactttgggtccatttttaaatctgatattaattcttcagtagctttttttcccacaggtgttcagcttcctccccgtttccacctctgttcacatctacaactcctttatggttgtaagtcatggcttggctggagcttggacatcaccagccattgccatatatggtatcacagtgaataggagatactagcatctaagatcagctaaatattatctgcctccattggttttcatcaatcccaattgctactgttccttctggggaggggggcctcctggcccagttgggtaccaacaaaatggtctgagacaagtttggggcaggttggacagcaatcacataggtcaacaggggaaggtaagtgcaaaaagggctagccaagttcccaagttcagagagagcacatctaaatacaacaggcgatggggagcagaggcaagaaccaagaaatggggccaggcgtggtggctcacacctgtaatcccagcactttgggaggccgagttgggattgcttgaggtcaggagttcaagaccaacctggccaacatggtgaaaccccatctctactaaaaatacaaaaattagccaggcatggtggtgtgtgactgtagtcctagctactcaagaggctgaggtatgagaatcacttgaacccgggagacagagtttgcagtgagccaagattgtgccattgcactccagcctgggtgacagagcgagatcctgtctctctctctctctctctcacacacacacacacatgcacacacacacacatacacaagaaagaaagaaaaaagaaaagaaaaggtagaagatgactgaaaggtgttccaggcataggggacagcatctgacagaaacaaacctatgaaaggctatagattgcttaggaaaagctaacaattcagtagtcttggtgaaaggtgttcatgagcccagttcagtctgctttctgtttgtttgttctcgtttttcatttcaacaagtatttgttaagcacttacgatatgtcaacactctcttacttggcctaaatgagaactcactctccaattttcctcttaaatctctatctcctttgttggctattcttcccttgtttcatcctttaagtgttagcattccttaggatgtggcctagactcttttgtgttcacttcatacccactccaaacctataaatgcagtctaaatctctccagtgagttccagacccatgtcttacttatttgacctctctcttaagtgtccaacaggtatctcaaaatgacatgcccaaaacttgtcacgcacaccaatcccagcataaactgaagatcatctggtgcaccaggggtcctcaagtcatagctggccaattggctgggttccagaattatgtgagtgccacacactttccaattatgaagtttccaactatgcagctatcatctatgcatggctttggtctgccttgtttagccctcccttttttatacctctcagtggccagttggccaccagaaatgaagactctttaaaaattaaatttaaggtccaaatttcctctagaggaaaacaaatgcttatatgttttggtataaaagatatgttcatgttgcaaaagataaattcaacagtattgactacagtaactgtggtactaagttttctctacaatcttgctactcagtgctatcagcaaacccacagcatcagcatcacctgggagcttcttagaaatgtagaatttcaggccccaccccagacctactgaatgagactttgaattttaacaagatctccaggtgattcgtgttcacaataaaattggaaaagctctgctatagtatgaaacattgaatgtgtactcaagagccctgtttccttttgaaatttttccatatcatgctcaaagggatttaaacacattcattgcaaagattatttttgtagctctggatgttgtcatcatgaggagatataaaagctccctctaattcactttatgaagaagttgatgccttgaacattatgttcacttatcctaggatgaacatctcctgatcattagaaatttcttttcaaaaatattctgcatccaaatttctgtttttaagagtattatgtttcagttcttgcatcaaatgctagcatggagtttatttttagtgtcatgataaatctatagaccagtgaatatatcatatcaagagttgagtcagtaaaagctttttaaatatatttcttacttatttgaaaataacagatgagtttttgaaaaataaaaatttggcaaagcctgcatgatgaaatgccaaataaaagatgcaatgtaccttgtcatcgatacattttccatagcatttatatgcagcaggataatttagtaagatattcatttctgtctgattgttactgctttaggagacggatgaaaagatttattttcctttgcgccctctacatgagcaatcaagcctgcatgtcttggcgaattagctcattttcaggagacttggcctatagaggttatagagctgaattactagagcaggggcatctcccaaggtttgaggaggaggaatttgaaatggaaatagagggagagaatagtacttcaccagagacttgggaatgagtcttctctggtagtgcctgagaacccaggaaccctcaaagaagctcatttcccatgcttgccatagaaggaatggaatccccctccttttaacagcccacaggggctacagtgagcatctccgtggttatctcctctgtacctatattagtccactctcacactgctctaaagaactatctaagactgagtaatttatgaaaaaaagtcgtttaattgattcacagttctgcaggctgtacaggaaggatggctgggaggcctcaggaaacttataatcatagcagaaggcaaagggaaagcaagcacagcaggggtgagggagagagagtgcacgcaaagggggaagtgccacacacttttaaaccaccacatcttgtgagaattctatcacgagacagcactaggcggatggtcctaaaccattagaaaccacccccatgatccactcacctcctaccagtccccaccttcaacacctggggactacaattccacatgggatttgggtggggacacagagccaaaccatattagtagccttggcaactgaaggctaggtctccaaactgaatatgattgaattgttgacaccctagtgaatgtggctcagtgtcagaattatttgatatcaaagaaaaaaagttcatttcacttcagttttgaagagcaaattcatttcatacacctactttaccttagagagtaggcttatgagctgaggcactgggatacactgctattcttcagcagatcctaggaaagcactttgtacatagcagataacacatggacattgttgattaactgcttactagcgacagtaaaacaactcaggattcctggcttttaatatcaacagtctacctagtaaaactgcttctcaaaagcttcccacattttcggtgcttaaatgaaaatatacttttctttttttatgagtagctgaatccttttgcatagaccgtaacttagatatatgaagacatttattgtctttccaattctaaatttctaaataatctaaatatgtaaatgtctccataatgctttgctagagactgtatgtaaatatcattaggctttctatttaaaaaaaaaaatggaaaaagaaaaaacaggaaaacctcttaggcacgtctgtcttttaaaaaaataccatttcaacctcaaatttgatgagacatacacattgctttttggatgccctttaatttttttttaattctaagaaaaaaaatggaggagatttaaagtagtttgacatttaagaatataatctaacttaaattaggattgaggtactgcaaatgtagacattttcttttgtaaacaaataaatagaaagtaggacaacaagtagaattcaaggtagctcaaaaaatgcaggatgaaaaacacttgaaaagaaaatggaaatactgagataaaaaaaattcaacacgtcaccaaaagactttttgggagagggactgagaagagtagggggtagattaaatatactggttgagaaaccagcattagagaagactagggactaagggtaaggggatgagtggagaaggcagtgtggcttgagtcaacgttgaacttcaggaacaggagaagaagatgggaaagaggaaaagaaagacttttaatcccctgtagcaggagatggaataagcaaagaagtcactgttttccctccagccttccatccctgctaagtggctactattgaattaatcatctgtaaatcatcattctggactggcatagccttggtttagggtgtctcatttcatccatataatagtcgccagggctactgagtcccttcaaaactagtaatcagccagatgtcacaatcaaacatgtctgtgcctatacaactgctacggtttgaatgtttgtcccctccaaacctcacgttgaaatttcatccccagtgttggaggtggggcataatgggcggtgtttgggtcctggggggaatccttcctgaatacgctaatgcccttacaaggttgggggagtgagttctcactctgttagttccctcaatagctagttatttaaaagagcctggcaccttccctctgtctcacatttcctctctgtgtgtgacctctgcacactctagctccctttctgccttcagccatgagtggaggcagcctcaggccctcatcagatgcagatgcccaatcttaaactttccagccatcagaactgagccaaataaaccttttttcttcataaattattcttagcctcaggtattcctttatagccatacaaaatgaactaagacaactttattattctgcccatggtttctaataaaacattaccaaattttcttcaaaaattcctcagatctgtttcaatatgggtcaaatatttttcaaatattttgtagaatgtatctttttcttccccataagaaatagaagccatcagttaaagatacctcttaatttcacatcatcacatgacaaaccttcccttccttcttcctttccctttccctttcctttcgttacaagaaaaaatgtcacctttgctatctaaagtgaagcctcaactctgctctgaattgcacatgcagcagcctttttgagcttgacactgtagattattgcctctctctttcaagtcattaaccacatactttcaactgggtcctttctactggcatttgtgtatactcaagcctctccaattcaaaaagaaaacattttcaaaaaagaaaataaaccattactcaactcctcatccaactccagctctcaagctaatatttgtctaccttttacaaccaaactttaaaatttcaactaagtaccctctccattgtcttacctcccactcacttttcagcattgagaccggcttttgtcccagggctgtattcaaactgctctaagcaagatcataaaacttttcatgtcacaaaatccaatgctcaatttgctgtcctcatttcacttgaatcagcaactttaaaatctggacaatattttccttggcttctacaacacgctctcttggttttctcctacccctctagatattccttctttgtcatctcctctagttcatctttatttgcttacaatttaaaagtgaggttccctgaggcctgacctgagccccaatatttttgcaccctttcattctcacaagatgacaatgtccaacaagtttatgactttgatcactgtcagtataactacaatgcccaaatttatctctgaaatagtcaactcagacttctctaaaatgcaaacctactaccaattggataatgaacctccatttagaaattttaaatttaccttaaattcaacatgatcagaactgattgcacagacttgcgcttctggccaaaacgaaataactggaaccagatgtagcccctaccctttaacaaaatattgggaaatcaaccttaggagtatataaaaaattaaataaacaatgacaaggaatgtaatcaattcaccatattaacggtataaatacaaaaccataattggtgtagaaaaagcatttgaaaaaatttaacatccattcacaaaatagataaataaacaaataagtaaagtctcagcttattaagactatacagaaataccctcaacgtgataatggacatctgttgaaaaaatacatctaaaatcatacctagtggtgaaaggctcaatgcttttcccctaagagtctgcaagacacaagactgtccatttcactggaaattagcaagctgattctaaaatttgtatggaaatgcaaagaatttacaatagctacaataattttaaagaataagagcaaatttgaagaattcattaaatgttttctaaacaaactataaaactacagtaatcaacaaagcaaagattggcataaagctagatatagagattaatggaaaaaagtgaagagtttagaaatggctataaagatgccaagaaaattcaaaggggaaaggataacttctcaacaaatggtgctagaactgaataaccatatgaagaaaaaagacacttgattctcataccatgcataaaaattagtcaaagtggacaactgacccaaacacaaataataaaactatacagcagtacacgcaaggatacaaaaatactagaagaaaatctagggaaatctcttcaggacaaaactcttctagacaatgaattcatgactaagacctcagaagcacaagaaaccaaaacaaaactagataaatgagtacttaattaaactaaaaaaccttaacacagcaaaagaaataacagagtgaacagataacctgcataattagagaaaatattggaaaactatgcatccatcaggggaccaatatccagaatttataaggaactcaaacaactaaacacacacacacacacacacacacacacacacacaaataactattaaaaagtgagcaaaagacggttttcaaaagaagatatacaaagggccaacagacatttgaaaaaatactttacatcactaatcatcagagaaatgcacattaaaacctcaataagatatcatcttacactagtcagaaccattactattaaaaagtcaaaaaacaacagatgttggtgaggatgcggagaaaagggaatgctttatactgttggtagaaatgtaaatttttacaatctctatggaaaacagtaaagagatttctcaaagaattaaaagtagaactatcatttgatccaacaatcccactaccgggtatctacccaaaggaaaagaaataactatatcaaaaagatacctgtactcatatgtttatcatagcactattcataatctttgctaaagatatggattcaacttaagtgtccatcagtggatgactggataaaagaaatggggtatatatggacaacagaataccattcagccgtaaaaataatgaagcatgtcttttgcagcaacatgaatggagctgcaggccattgtcttaagtgaaattactcagaaacagaaagtcaagtatccgacgctcccacttataagtgggagttaaataatgtgtacacacagagtatagaatggtaggtctagtaccctcagaagggttgggaagagaaatggggtgggtgatgaaaaattagttaatgggtacaatgaacattattcaggtgatggatacactaaaagccaagacttcaccactatataatatgtccatgtaacaaaattgcacttgtactccttaaatgtatttaaataatactactaataaaactattagaaaaacttaagtgaaaattttcacaaaattgaggtaaagatgtttagaaaagacacaaaaagcacagttcataaagtaaattaacaaattggaattcaccaaaataagaaacctcttcacatatcattattaataaaatataagtcaaatcacagattgaggagaaaatacttgggggctatatctgattaaagacttttaccaagaatttttaaagaactcttacaactcataacaatacaaacagtccaaattttaaaatgggtaaaaaacttgaacagaaattcagaagagaagatatacaaatggataaataaaaagatgctaaatcatattactcttcagggaaattaaaattaaaatcaatgagatataactacatacttactagaattcctaaaggtagaaactgacaataccaagtagggcaatgatgtgaagcaacttaaactctcctacattgcagttgagaatgcaaattgctacaaccacttttgaaataatttggcagatatatatatcccttatgtgtgtggggggtatacacacactcacatatgtacatatgtatgtacacttataaaatataaatatatgcatctaccacataatccagcaattctactactaggtatacttacccaagagatataaaaacatatgttcatacaaagacttgtactcaaatgttcactacaattttattcacagtagcccaaaattgaaaacaacctaaatatccatcaataggtgactgaataaacaaactgtggtgtagcaataaaataaaatacaacttggcaatcaaaataaattactgatgaacacagtaatatgaatgaatctcaaaactattatactgagcaataaaagccaatcccaaaagattacatacaatgtgattctatttattgaaattccagaaaacacaaatctaacctacagtgagaaaatagatcagtgatttcctggggccagagcagggtaagaggactgtaaatggcacaaggaaagtttttaggtgacggaaaaatgctatatcttgattgtgactgtgatatacaggtttatatatttgtcaaaactcatcaaatactcatttacactaggtgcatattattatatgtaagttattatttaataaagatttttttaaataatcaatgcctggtctctccttccaccccagcacacacccttcaaaaacaagtcctccttaagttatttgaaatcttggtataatgttttcttacttccatatccttcaacactcatgttcatgcaatcactatattctgtttaccttcaaaatatctcggcgtcttgacatatcttatctccactggcacctttaggcctatgccccattagctcttactcacatctcttgtgacatctcagcaggcactctcatggccttccaatctattttccattctatttgcatttctcaaaaatataaaagataaagggtcttaaaaataatgtgtagctactcacccaatgatgctcaaagttggtttgaaaaatctgggtttgaatcttaagaagtggtttccaaagctgagtatcagaattacctgggtggctttttaaaaatcagatttattaacctcatatggagattctaattcagtttgaggatgacaccaagcactttctccaactatcctgataatcatctagttttgaggatcatactactctgatgtcagtggagttactggaaggttaagtctcatgccaagaccatcaagctgagtcattttatttataccactgtttccatacagcctggcagctatccactaggaaacctgcccaccaagtaccaggtttaccactcactcttaccaaagtcatctgtctttatctgaaagatcccttcaatggtagtaattattgtaatactaattattgtaaactttccaagcacttttatgtatactataacttttgcaactatcttataaagcagatatcattatctctactttataggtaagaaaactgagacttgaaagttagggtcctttgcttacaaacagctaatgaataacggtaaggtttaagccagaatctgtcagattccaaagaccacattctttctgtgatactatatagtttccctaggaataagcagggaaaaaaatgttccctgtcatattcactgcttcctttatatctaccttctgaatttgttcttctccagtcagcttttggatggcagctgccacagcagaaggcccagcaaacaactgaacaatagctaatatctgattacaacagggaagaaaactgacaggacaaaaaacaaaaccacatgaattaaggtcctatggcaactgcattatcaatattaatcatatgacttcataatgactccttattcaccatatccaacctgataaattggaattatttcttcctacgaataaatgatatgtaggaatgtctataagtatgtcaaaatttcatgcatcgtgaatttcatagcaggaacccggctaaagtcaacattcatatcctaacatttttaataaatctatagaatcaaaggtataaaccagaaaattattagcctttcagttgaggtataaacaagactgaacacttttatttaccattccttgctgaagctattagctaatagccttaatttatgaaaagatatttatttcctttgaactgctttccccaaatcaaggcaaaagtactcagcatctttgagaaactaaactgttggacataaaaccaaacttcttgttagtataattttaatcatcactttattatatactgaaaatatacatgtactcatgtaagttaaatattcaaaatagccaaaatcaaattcccaaacacttgtgcaaaactgctaaaaatttcatttttcatcctcatctagacatgacacagaacagcttgccatgatacgcccttctcaataagtgtaaattacacacagtaggggatttaattcccagaccatggaaagctaaaccaatgagaaaaatcaatccaaaagactgaccttggcagcccaatcgtgaatgtagttattttcccttcagccaaagtcacagtagagattctttactctttctagtttgtcctagaaaactaatacatgggtcaaacaataattttctgaatttggaccgctgttgcagccaatcaagataattttgaagctattcaatctctgagtcatttctcagtaatagaatttgtggcaggtcaggaagaacgatatggtttggctctatgtccccacccaaatctcatctgagattgtaattcccatgtgtgagggaggaacctggtgggaggtgattgaatcatggggtcagtttcccacatgctgttctcatgatagagagttctcatgagatctaatggtttaaaagtggcaggttcccctgctctgtctcctgctgccatgtatgacatgccttccttcccctcccaatcatagaagcatcatgactgtaagtttcctgaggtctcagccatgtggaactgtgagtcaattaaaccttttctttataaattacccagtctcaggtagtatttttatagcagcatgagaacagactaatacggataattggtacagggagtggggtactgctataaaaataacctgaaaatgtggaagtgactttggatctgggtaacaggcagaggttggaacagtttggagggctcaggagacagaagaatgtttagaacttcctatagatttgtttaatggttttgacaaaaatgctgatagtgatatggacaatgaagtccaggctgaggtggtctcagatggaaataaggaacttattgagaactggagtacaggtcactcatgttatgcttttgaaaagagactggcggcattttgcccccgccctagagatatgtggaactttgaacttgagaaacatgatttagtgtatctggcagaagaaatttctgggatgattggttttgaaatgtgaaaaaggcatgagatttgggaggagccaggggtggaattatatggtttagctctgtgtgcccacccaaatttcatctggcattataatccccaagagtgagggagggacctggtggaaggtgatgggatcatgggggcagtttcccacatgctgtttttatgatagtgagagagttctcatgagatctgatggctttctcctgctgccatgtaagacactccttgctttcccttcaccttctgccatgattgtaagtttcctgaggcctttacagccatgcagaactgtgagtcaattaaacctttctttatagattacccagtctcaggtaataattttgtagcagtgtgataacagactaatacaaaaaggtttttgtttgggagcagaattacaagagttcttaattgtctgagcatgtgttgcccaagaaaccttagtgcaggagttgcatggagaagcaagttgtcataaatgaaaatattcactaagccactgacctctgaaacaggctccctcccaaccttcacttttgttccaggcaaaattttttaatcaacttcttgttgattgcttacaatagccaaaagtaaaatgcaaaacaactacaaaatgaaattggagatcttataaaagatccagagttatagaaagtcactggaagcagcattgaaaacttgccagaatcatgtgcaaaatcatggacatatgacctttgggatgattagaccaagggacagacaacaaagttttcagaggaaagtggtttcataattttgttttgatttttgatataaagcctcaatcaattttttaaactatttatctggaaaagtttattcccattctaagtagaatcacatgtaagtgccatattccagggccagggactgtcagataacgagggcttccttgtaccaccttctcaattcttctctgcctgtggggacactggtttaaggtatctcacagtcccaagttcctaattttcttattttattaaaatgataatatgacttacatatttttaggaaatcaattttccataattttcatttctgtgttttttttcaaccaggctttaaagacagaattgactgaacccatctaccataattttgtggtgggagacttgctgcatgtctattatttcttgctatattactcttataatttaacatttcctcttttatcctttgtttcctggaatctgttatttatgcttaattatgttttcttccctaaacctatacagctctgaactcttaaatgcaagagtaatctgaacagcatgaacttaatttataactctaataacatttttcaaaataaagagtagccatttaaaacatgtcatttattttgaattcggcagtcttaaggaaaaaaataataaatagggacaaactataatccattatgcaccacagaccagtcttcattatctatggcaagctacaatcagccttctctgggatacagcaaatctgaggcctggatttggaatcagggtcttgctttgttagaaaaaataaagttaacagggacacagctgtttctcagaagatgaagttgggacacccttgttcactttcaaagttgtcggacaaatttgagattcacacgctaacagaaaatgctttcccctctcgcttgctgctactcatcccaattcctttgcttaggctataatgagaaagttacttttattgcattttgttccttttaattatttcttctccttttccaagctttccaagtcatccggtctttcattcattcatttctcaaatatttactgagtatctgtcacatgccattctgctcagtgctagagacacaataaaacagacatagttcaagaagcttaggatctagtaggtgatacagacaacaaattgacaggagctaatgaaagcggtacactggaaatagtgtgtgggagagatgaaagtgaggaggaatctcactttatttgaagggtcagataggcactttctgagaacatggcatttaagctgagatttgaaggacaggagggagccttgccttcctggcctcgcaagtacctgaggaagaggtttccaagcaggggaagagctgatgtaattatgccaagaaatgaaagggtctgggcactctaggacatgcttctgtggctagagtggatgaacggacaagaggagtcctagatgttcactggcaaaagcagggcacatagcatgatcagtccccagacccacattccccaagtaaagcccttggtagagtaatagctgggatgtttcaagaatttaattagtcccataaatctctaccaacgttttaaaaagcagataacaagctgggcacagtggcacatgcctatagtcccagctactcaggaagcagaaggattgcttgtatccaaaagttcaaagccagtagtgcaaactataattgtgcctgttcagaggcactgcagaccagcctgggcagcataagaccctgtctcgggccaagcgcggtggctcacgcctgtaatcccagcactttggaaggccaaggtgggcagatcatgaggtcaggagtttgagaccagtctgaccaacatggtgaaaccccatctctactaaaaatacaaaaattagccgggcatggtggcgggtgcctgtaatcccagctactcaggaggctgaggcaggagaatcgcttgaacctgggaggcagaggttgcagtgagctgaggtcacgccattgcacaccagcctgggcaacacagtgagagtctgtctcaaaaaaaaccacaaccctgtctctaaaaaagcaaacaaaatcccagcactttgggatgccgaggcaggcgaatcacgaggagatcgagaccatcctggctaacgcagtgaaaccccgtctctactaaacatacaaaaaattagtcaggcatggtggcaggcgcctgtaatctcagctactcgggaggctgaggcaggagaatggcacgaacccgggaggcggagcttgcagtgagccgagatcgcgccactgcactccagcctgggcgacagagcaagactccctctccaaaaaaaaaaaaaaaaaaaaaaattaataaatacaaacaagataaactggcattttttcacccttcttgggtttttttctttcttaattctctataatgtgtatgctactgaatgacaaagtagtcaaaaagtgttatcttcctaaaagttctagctgactaaaggaaaagtgtatttcttggcagttctagctgccaagaaaagtatatttattgagacagatgcactcattaagcacatgaactttggcatccaggcaaattctgggtgtgtacactacttccaccgcattttatctctgtgagttcggtattatctccattcatcctcataggtttatcccttagcttcctctttccaaaaagtaggcctaactatgagactaaataatacatgtaaagcatttgatacagagcctagtacataaaagtactgactaggcattagctgctatgattataatttcatgttattatcatatactctatcaggcactctattaagatttaacttccgggcaaatcaagaacttgttgctaagtacatttgtgctcagaaagtttccttcgttaagaaaaaatggcaaaaattactaaagaaaaggtgagaaaatatctactatgctgcagtaaagttgttcaacacttcaaagatcaatttaaacagtcacatcttgttacagatctcacctccatgaaatatcaccttgacttgttaaatcactgttacatgaattccaatgggcctgatttaccttaaaatctgcaatgattcaacaaagaaagtgtgagaaccaaatgggattatttgaagcatgaactaaaacattttgatatcaattgtaaagatggtcaaaatattaatagaatttgaattgtaggaaaggcaaaacaaattttaaagagaaaaaattaaaattaaaatgcaacattgttcatcttgctaccataatattttaaaacattataaatatcagagcagtgctcacatatttcctggtctgttaactgataggcattttcttatatacaaaaaaagttaagatcttaacataaaatgtaggcaagacatacatcttctggacataaaaaacattttagctaagtgaaaagtctatcaaaatttcacctagcttcctcctgagctctgaacataagtctgcaactttcacaaagacctttaaaacagctaacatttctgcaaacttcataaacaatttttaaaaatgtattaaacacatgaataacagaaatttaacatgatgaaaatataataggcaaaaagatttttatgtttaacacatcattgctaaaaaatgatgtgttaaataattctaatcataaaaatatgactacctgtcttttttttagatcaatgatttagactttactaatttggaattagagaagatttgggctgagtcagggtttatgtttctatcatccattcaaaaaggaagtttactcagtaaattcatatgatgaaaacattttcaggaaaaaaaatatttaacccattcaaaagaaactattttgtgaaatctaagaatgcccatttccatataaataaatctgagctttgtgtaaaactaattataaatctttttttcactattcactaaagcaggtgtacagaaatctaaccaaaaatgttcaaaattttaggtggtgtttgagctattatagatatttgaaaataatagaactacaatttaaaatatttataataaagacattttactaattccaactgatctttccccaccttccctccagatttaacattgttctgtagttaaggatgggaataggtgagaagaggctagttagaaagtcagagttgacagcttaagaattaatgagatcgcgccactgcactccagcctgggcgacagagcgagactccgtctcaaaaaaaaaaaaaaaaaaaaaaaaaaaaaaagaattaatgagtaatttttttcataaaccgggcatgaaactgttacatgcaattgggcagagagattatatttacattcgcctacaatcgtttttcttattcctaagaaaaatttaaatatgataagataggtcattttctccatttggtttgctccaaggaggttgttgatttctggcaaatagatcttaactattattatttcattagatagtaatttctaaaaattgagaattatttttcctcttcaaaccaactacatcttgcacaatgctctggatattgtaggagtcccacagaagttcatcaaattcaattgaaagactgaaattattcagtaatcttagattcttcaataccaaagcattaagataaaatcagacaagagcactgaattctgaactaattcaataaaagtcatcaattatgaagcactttcactaacacatggctacatatgggcacctaatttaaaaatggcttagttattaaaggacaaaaataacatgaatgtcacagaattttcaaaggagctttataatatgtgtaacttgctagaattggggttatcaaatttaatatgaacagctctcatcaaatttgaacttaatgaatgcagttgtgaaacaggcaaatccaatacactgcgaatagtctaactcttaattcattccacagatatgatttacccctaatagccagaagcatcacttctaatagctcacgttatggcagaatggattatgttgtattcattctacctcctggaaggaagctagtatccataatagtaccattcaactgtgtgttataaagcacaagccagcagaacttttataacataaaatgtgaagatatttaaaacataaatttagtaggttgtgacagatcagagacttctctctttccactgaagggatatatttttttattcagatctttcaaatcctggtaccgaagctcagctacaaacttacccagcactggaaaaacatgtcagcatctgtgctgtactttgagactcaactcactatttctataaacatgtatgtacacaggcaatagacgtctctacaaagagtaaatttattgttcacttaacaaggaggatgtgtcagcatttgaggatgttttggacacttacacttctttttctgagaggaatgtgtaccaagcagaagggctccagattgctaagagctcaagctctctttttaaatattccactcctgagaaaattccccatcagatataggcaatttctaaaagactttcaatctaaggatatttacatatatttctgaaaaaaaagaataattgcatattagcttgaaagaatgtatataagaattaaatcacaggataaaagtcacattgtcctgcaaagggcataggttttacggtcattcagacctccaagttcaaatctgaattctgttaaaaaccagctatgtgatcttggatgacttaatctatgtaagccttgattatctcatctataaaatgaagataaaagcaggactgttctaggagttggagtttatacacatacacatgcataaacatacacatacacacacacacacacacattccatatagtcaggtcattagcacaatgccagagagtaggcactttgcaaactggagcaataaatgcctagtaatgtggatacctctaagttgtataggcactatctgctcatgttctcaccacctcactacattatgggccattacagacaggaactatgtcatatccaattctgtaatcccaagatctaacacaacacatagcatataatagaaactaataaactgctacttatatttggtaattgcagttggctcctcctgtatgtgaatagattttatcaagtaaatcaaacataaaatgaagagtgttcattcttaacctattaaattttctccttctttaaacttacgtaggttacttggctatgataatgagctgttgtttttctacttaaaatttaaaattcttccattgttttgccatctttgggtttgtctgggtccctttccaaaatttaatttgctttgctattaaaaaaaaataaaaacagaactatgaatcctgaatactaggtgaatttcttgtttgattcaaaatgcaataatatttctgggtaaaaagttaaataacagttttgcctagaggcaatcttcttcatttactgtcctttgtgaaaaagtaaagaaattaaaatattttttacctgactctaaacccataggaaagtttcaatttagagtttgtactaattgcttaagctcctttccttttaaaaatgagattctaattttttaacaacttgtcaagattacagcagcctgtttgccacaaatcagatatttactttctccctctctcttctctaaactggttctccaatcccaatcaaaagtatacaagcagcacctgcaattccctcttcacaaagaatgttgaaaacagatagcacaagagaggttccacagcccttaacggttcagtgcagagctgcaaagcccttgcttcaatctacctcttccaaacaagaaaatcatgtaatcgaatcctcctccccacccattgcattcttttaaaatttttttttgttaatttcatataattgggccagtatacccagaggctcgaatattccctatacacatcatctcttagataatcaaatcagttagaatctgcagaacctttccattccccacacagggtccagaaacctgtattttcataagcactccaaatgatcctcatacaagaaatactgctccagcccttcacttggagaatatgcagcctaggcaggcagattttcttcatggcttctcatttgggtaaacaagctgagggttcctgtcatctgagtgatcccagggccaggatctgaatgacttgaggtttaatgggatcacaacatttccatttcattataactagtatttgggttaataaagcatttgtctcctggaatttgacctgcatcactataaattttaaaaattgtaacacacacatacacacatatgccaaggcaacttaaggaaaaacccaaagaaaagagataaaacaactctctttagtgacgaaaagcactgaagagtacccaaaagcacaacctacctgaaatccaactttcagctcaccctctctatcttaaacaagacgaaaatcagaacaaagaaaacagagtccaatgcaattaacaacaacagtgataataacaaaaacattttttctgtccttactaacactggcactctgtcaaatgagccacatatattatttaatcctcacaacaatattcctcatttcacagataagaaaccataagcagacagatatatgcgacatgcccaaggtcttctataataataagtggcagaggtggaactccaacttaagtgtgtctgacctctgagcccacaaattctaactactttgtcgtgctgacttccagcccatcagcttagattgggtggacagtggaaagaacaatgtgttctcatagtttcatgactgtaagttatccagaaacttctcccatgaaccaagacactgcactttgtacattaagtgtgacagtatctggaacacctcacatacctattgagggcctcatgttcttcttaccacagaaaagagataacaaaatgtaacctgagcacatccaaccttgaggcaaactatgacagtcacagtacctcatagtagtcacattagtgtggtaccatcttgaaaaatggagccatgaaagcaaaaatctcagaaagaaaagagcagtgagcaaactgcctcataatcaagtctaagtagatctattatttaaaaagtaactggcatatattcttcaagcaatattcacttaccccagagcaaagactttaagtttcagctttggaatcagttgctttttttaaagtcatcaaacctcctcaagataatcatcaatctctcatcagcaccctccactgcaagtacatcattacgattgttttcctttatctgcactaaatctctgtagctcatggaaagcctgtgttagagtagaccaagactgggcagtaggcagaaattcatggaaaaaaagaaatacacaagtccttaactttaagctctttctatcggaagttatacagagtgaaaaagagtagctggaaaggccatgtgatccctagtaaacatagtaaacattacacagaatcccatggaagctaggtcacaactggcgacaatgtgccactcatgctagaagcacaggttccctcacaggcccatggatcaatgttttccagggcagccccactatgcttgctggctgggttgctctgcatctccagggcagcatatgcctaggctatttactctctagtcaagtcatgttttgccaacaacaaagtcaaaactaatttatgtgcacccagaaatatattgcattgctcatataaattcaatattcaatcaagactatggagtggtaatcttaatctatttcagcttttctcaatctcagcactattgacatcttagactggttaattctttgatgtgaagggccatcctgtgcattttaagaggtttagtggcatccctggtctctattcattagacagtagcaaaccctgtccccaatcccacacttgtgacaaccaaaaaatgtctccagacattgccaaatgtccctgagacagcaaatctcttccagttgagaaacactgttctattttctcaattgtcccctatcaatggtcttgaaaggcaaatataatatttctacactacaatgtaactatttaaaagatatttcacaccccaggttactatcagcctcagtgattctgacttattctgtctaacttcaagtgctctgcccttctcattctggtgctgttacctgtacttcaaatgcccttgggtggagtatgaggggcccacttccagggccctgactgatttccatctctccatttccttttctgaacacctggggcccttgaacgccacccagctttagggtcacctccaattttgtctctcaagaactgatcttgatttggcaaggaggaatacgatcctcatattctggtagtcagtgtcaagttactcctgctgtttgtcattaaacccatccttgtgactcacttttgaaagccaggcatgtgccttgagctgcagacaaagtctccatttatcactccatgttgataatgtaagttgtgtttttttccctacactttcatcattggtctcatgctgtatgatcctctaggattaggaccctgaattattcttaccagtcccaactcagaatttgtgactgtctgcatgctgacagcaatgttaactcaatgttattttgtctggcccttggaattccaaatattaccttctttggaggtgaccatcactgagcttccacaatctgtcaacccttgctcattagaccttgctgcacctatatggtgccaatggccatattaggccactaccagctgccttctcaccaaccctgcggctctcatccttagcctgctggtctctttctttaaacctaacccctccctagtgcccatcccacccacacaactgaggggtttccaggtccagatcttggctcatgacattctagataccctggcgaagctatggcactcagacctgagtagatgctagaattcatgttcaattaattcttctagatagtttaccttaattttactcaagacttaagccagaatattgctttatctagtcagataatccaaaaaattgttgaggattagaaaatgtacagaaacaggatccccagtcctacttcacaatgaacctaacatttgaatacattatcctttttactctcacatattttctcaggaaatgaaagactttcacagttgtcacacctatcaaaacacttaattgcatcaatttctctacctcatctccttccttcttcatagctacagtgagcataaaatttaggtacagatacctcaaaaataaaaataaaaagaatgtaaaagtgttaaaatccattaataatttaatttcagcatctgtatggagaagaaatatgctcattgtggagagaactttataacaggttactgtttgcaatcctctgcctttatggagatctacatccaaaccagctcaggcacagaccaagactagactatggcaatacccaataattaaccattagcctggggcttcacaaaaataggacccactggagtgcagcaaatgctttcagagcttcccagaagctggtcaagaactcttaatactagttgacttgtctgtttttgtttttgtttttttttaagagaccgggtcttggtctgtcactcagcctggagtacagtggtgtgatcatagctcactacaacctggacttcccaggctcaagcaatcctcctgcctcagcctcccaagttataggtatgcaccaccatgcacacctaatatttttttaaaaattttgtagagatggggtctcactttgtcatccagcctggtctcaaactcctggcttcaagtgatcctctcacctcagcctcccaaagtcctgggattacaagcgtaagccaccatacccagcttatactaattgacttattttactagcatgcagttggttatggtaatatgagtgcacaagctagtgcatggactggggaaatacacaagctaaatgaggcactgtgacagcaagaaagagaagtcccaacgacacaagccagtttacacacaaagccaatttctcccagtgacaagtagtgcttttcaaattgcagatcataaccctgagtattgcaaagaatgacctattaaggttctctccctcaataaatgtactcaaattaattcagaaatttttttctttttatgaatatttgagaatgcactgtaagcaaatagtaagcataagaatgtttgatgaaatatttttccagataaattgatagatatatgatagatgattaataggcttgatagatgcatggatagatggatggatggattggatggatggatgggatggatggacggacagatggacggatggacagcgagacagattgattcaacaactatttattgagcatttaccatgtgccaagtacttctctagacacttggatacattagcgacaacagataaaaatccctgcatttatgatgtttagtagaacagacagcagagaaaaatatatttattagtgtaagtcatgatttaaaaaaaataaataaccatttgaaagccactgttgagagtaaggagatgccccatgcatctttccaccactccaaggagagaaccaaccaataatcatccttccacagtggaaaaccctagaggggtgaagtgaaagggacagtccaagtcattccccttctccctttcaagctggtctttaagattaagcatggcttcctgaagccaagctctctttgctctgttttgcatcttcccctttaattttgcctttttcctacagttctaataggtaagcctgttggaagggaaggaaaacagcaaacgaatgagctcttggtggatatttcctagtagtgtaacagatggagaggattcattttatccttaataaatagtcacttccaataatgggcaaaccattgaaattgtgatagcctattgtcttaagccagttaaactacacatctacctctgttgttactaaatctcttcagagatatcctaataagtattaactaatatccagtgtgatacctctcaaaataacttgcttatttaatttgtagcagctgtagctcacatttaggggtgtctagtataagcataagcccatcattgcaggctatgtgctttacctttaatcttcatgacgaccctgtgagggagaaatcattatctgcattttgtaaaagaagatactaaagcttacagaggttaaaaaatttgcccatgatcatttggctaagtggcagagctaaaattttaacaaaggccatgtagctccacaaaattactgatggtatccacattaagggcaaaggcttattatatatggaaaaaaattaaaaattattctcagaaaacttattttacaggcctatgcttccccttgtttgcttttaatcattctttaatatttaatggtcattaaaacactataaaccattaagtttagaactgaagagttaacacaagcactttttcttctctttgctgcaataggtataaatgtgtgagtgctaaaaatattttgatatctcttgcacaaaaccttttcaatacccataagtagagtaggagaataagaggacagattctgtccagaatatttcgcctcaactcccagcctcactgcttatttgctatgtggccttgagaagtctgtgcctcatttcctcatctgcaaaatgggaataatgatagcagatacaggattgttttgaggattaaaaggcatatacttggaacagtgtgggcactaaataaaactacatatttgttatgcttattattacttcttaagcagcactggctcatctcattccactagacattaaagtcataaagtttatcaagaagaaaaagaaaagaataagttctttaaacttgaagctcagtaggagcaaagagctatgtctattccatcatctgtcttttcaatcccccacgacttgtgttgctggtagggcacactggatgctattgctaaccagtgctgttttgggaaagcactacccttcataaattatttgaaaaggaaccattttgcttttatactgatctatgagatatcattgcttttcaaaacacaatcagcatatgtttatttactaaaaagaggtcaatgccacaggtttgcatgaaaaagaaaaatcatgaccattgttaaaagaaaatccaaaccaatttttcagcatagttctatatgttgttttaaacaactatttcaaatgttgctcaaatgaaaaggtcaagtatacatcaatataaaagaatataaaggttttcattatcttttagtctgttctcactgtcagtgaggcaagaacatgtttaaagtgcatctccccataatcaatttctttacttagaaatgtcattctgggtggacattttacagctgattaatttctgtccttctttctcatatgcaaatacaagactaaaatgcactctctggtagatttcctttctgcggttaaagtgctaatttcctacagatcggttatctacacagttctagcagaaaaaaatgatctttcaaactatgctcttatgtttctttaatatatgcatcttttccccaaaatatttgcattaagtcgacaaacatttgaacataaaaggtagaagacattgtcatggcttttgtcaaaaagtcaacatattaagtattgtgcacacacaaatgtactcaattaacattttaattaaggataacaaatagtaattaaacagatgacattttaattaatttctcaactgtaaacagcctgatgaaaattgttaaatctgattctagttaaatatctcttcttgcaaacatggtaagcccaaactaatcacgatcagaaacatttcccttttatgtacttacatagtcataatgtcattcgcaaataagtttttcaagttcctcagagttatgaaccacattctctttattatgtaggaagcaagtgatagcataattgtataataattgtttcaaggaacttctatatgtcttgtgaaaaagcacagtatactaaagtatttaatgtctttctacaattaaagattcatgcttcgctgttaaatccaaattaacaattttgtcaagcttagcaacccaattccataacatcaacttttcatattactgaacatctgtaatacctgtctctgattttgtaatacactaggggtagctaattgtgtcaaatggcattattaatttctcaaagcaaaattagatataattcatttatttttgaaaataaatatgggccattcaacactttgaagcagagtggcataataatgctgaaaatgatgcccaggatatttagtcagtgaattaacaagaaaacggaacaaaccctgctctgaggattactggatttagcaaaacagaacaaaaacgcaaataagtttgtcttttgttttctatattgcatgcaacatacttacaataaaagattattcactgtttatctgaaattcaagtttaattggcatcattttatctggcaaccctacttttaaaaaagcagtatctgtaagataaattcaccttgagaaacactttttttggtctctggtgcaaagtgggctatggcaaaatgggagcaatctggtggtagaggatgctctgggcctctctggggccctgagaggatactaagatgagccacagccagtattgagacagcatgtccaggagacaaatactctgtgtatttagtaagtcagatttgaagtttaaaaagttactgatctattttttaatctactctgctttgttttttaagtgtaatatagataggtctcatagggtagccagcctctctgttatattttccccttcagaatcattcagaaaaggcatgcagaccctaaggaaatacagcctacatcaggggcactctgtcgctgaagagagtgtaggagatacttgtggcattctatggtcccttgcatggcaatttctgaaaactgtggttcccagagctatggcttgaagagactcacaactgctctccacggcaaaagtgagcctcagaaaaaacagtgtgggggtctcatggctccaggagatagaggaacagggaaacaagggaaacccagggacaaacccaggaaaactcagagacaacaaattccaagttttggacatgtaagtgttttttcccaactgagaattctgaagaatatgagaaccaggacatatggtcttgaaattcctgttttaatctgcaagatcaaaacagaatattttagttcagttatccagatatttcacaaaagatgagtatcagctctagtaggacacagctaaggctactaatcccctccccttcacaaacatccctctgtttacctccacttactcaaaaatctcattaaaatttggtagtcattcatcttacagtaactctgtacaccacctcacctctgcagtcccatacctcttgagaggatcttccatgacctaaaagatgacccctgtcacctcttcaactcaaagaaaggatctccaacttaaaaagggggttgcttagggaaataaaaggggaacagaaactaatcacctaaaaccactgtctactcacagcgtaggaagctctttggtaggcattaggaaagcatctctccgtaagttagatggtatatttgtgtgtgctattattgctattgctatttaactgcaaatatgcaattatcacacctttagcatgaggttcagtagacatagaggcactagattcaacaatattgaatttacaaaagaatggtccaatgaatgaaagttgggcagccacagaaagcctcagagagctaatcaatgtttcccaagaagtctgaaccccaccaccaaaccaagcaaagctgaaagtaaacatgttccggccaaagtacagaaagtaaaaatgcttcctactgctgtggatgagggtcctctgacaggccccactgatagagagtgggaagctcaagtttaccttaaaggaccttgtttcctaatacatattgttaaaccctttcgtaatgctctctgcaagcttggctgggtacttctctgctaactactaataagctgcagttttctcttggtctctgctttgggcaaattccctcctatccccccactcaccttgcttcagctgtccctaaggcttaattccaccttctgccctgtacaagtatactaacttagtatatttctaatatcctctaatccacatttgccatatctttcaagctgggttcaaaacacctctttttagaagcttttcagaattaaccaatgtaactaatgcaacccaattttgctgttttctcctttcatctataatgcctgaatccttttacacttatatgtcaagactttaccatgtttttatgttgtttacccagagaaagaatattagagctttgtaaaattattgatgcctcaaatgcagctttaaaatgagttaaataaataaaaattagtatagaagagcacggtaagctttgttgtttgaaaagataacctatctactattgcccatcttcgaactcaactcttcaacacattaatgtggcccatccccttgccattgaaccagcatcatctggaaacttgttgaagatacagagtctcaggtcccaccttagacccactgaatcagattctgtattttaacaagatgcctccagtgatttgtagacatgataaagtttgagaagccttgaccttccccatactaggcatgaaatattctacaaggaatatctcttaaatgggtgcaacagagtcgattcaggtatctctacttctgcccaatccaatccaccaattagaaagcaacttttccactaaagaagtttaagggatcaattcatcaagaggacatggctattgtaaatatatatgcaccccacaccagagcacctaaatacataaagcaaataatggacacggggaaatagatagcaatacaatgatcataggggacttcaataccccactttcaacaatagatagatgaagcaaaaaaaaaaaataataaggaaatactggacttgaatagcacttttgaccaaatgggcctaggagacatagacaaaaatttctgtccaacagcagtataatacatgcacatttttcttcaacacacatagaacattctccaggatagaccatatgttaggccacgaaacaatcttaacaaatttaagaatactgtactcatatacagtattgtttcaggccacagtggtatgaaactagaaatcagtaacaggaagaatcttggaaaattcactaatatgtggaaattaaataacatgctcctaaacaaccaatgggtcaaagaagaaagcaaaaggaaaacttaaaaataacttaggacaaatgacaatgcaaacacagcatagtaatttttgtcaagggcaccaagggaaaacaatggagaaaggtgagtcttcaacaaatggtgcagggaaaactggatttccacatggaaaagaatgaaatcagacctttatcttacaccacacacaaaaatcaactctaaataaaagacctaaacataagaccagaaactataaaacttctagaagagaaggagcaacagctcatggacattggccttgatgactttttggatatcacatgaaaaggtcaggccacaaaaacaaaaataaatgagactacatcaaactaaaaagcttctgtacagcaaagaaaacaatcaacaaaatgaaatgacagcctatagattgggaaaaaaaatactgcaaactatatatctgataaggagttaatatctaaaatgtataaagaattcatatattaatagtagaaaacaaataactcaattttaaaaagacctcaatagacattctccaaagaagacataaaaatggccaatagatagatgaaaagatactcaataccattagtcataagagaaatgaaaatcaaaaccaccatgatataccacttcacacccattagaatggttattatcaaaaagtcagaagacaaccaatgtgggcaaaggtatggaaaaagggaactcatacactattgatgggaatgcagactggtatagccattatggaaaagaatatggaggtttctaaagaaatcaaaaatagagctaccatatgacctaacaatccctcttctgggcatatacccaagggaaataaaatcaccactttgtaaagacatctgcactcccatgttcattgcagcattattcccaacagccaagacagggaaacaacctaagtgtcagctaatggacagatggcttaagaaaccgtggtacaaatatacaatggaatattgttcagtcttaaaaagaacaagattctacttgccacgacatggatgggactagagggctaagtgaaataaggcagacacgggggaaaaaaatcacatgacctcacatgtggaatctaaaaaatcagagatagagaacaaaacagtggttatggggtcagggtgggggaatgaagaaatgtatgtcagaggatacaaaatagcaggtatgtagaatgaagaagtctagagatctaatgtacaacatgaaggtcataggtaataaaattgtactctatatgagattcatgctaaatgagtgctctcaccacaaaaacaaagggtaactatgtgagataatggatacattaatttgcttcactatagtaacctttttactatccacatgtatcccttaacatgttttataccttgaatatatacaatacaatttattttataaataaataaaattctatttcccttgcctcaatgaaacaggaaagaagacaggcatagaatggagggctcatatgaaagaaaaattctgcctcctggaaaacaattgctaatgaattggtatttgacagcagaggcattgcaatggcagggacttcaaaaggaggctggtcactgaaaccagtggctgttctcaagacagtggaacaggagcacatggacatgcaggagggctctgtagaagccaggagccaccagaacctgaccagaaaagaagacaaaggcatcaggctgtccaaagtcttaatggggaaaaactggaaatttaaatcaaagccctactggctctcttttgcactcagtgttggtggtgcccagtgctacactaagcactctacctacctcattgacaacgactataatagaccataagtgttattattcccattttgcagacgggacaactgaaaaaaacagaaagactgtaaaagtcacatcccaaacacaccacttaaagtgatggcatgggattcaaaatgaatcccactcccagttctgtcctcaacctctatgctctactgcctccttctgttcaaggagagtagagtctgtatgggtcttattacacagtgtgggcccaccattctcagctgacccttgggttggcttcataaagcccagaattagagaaaccctccagatgttagtacacacctgtatctgaagtaggtaagccctgcctcaaaaacaagattgctatcatggtgagtctatgaaatgctgtcttaagaaggttgttgtttttttgttttttgcagtttgtacccatcaggttttagcagaacaacaggttttagctatacacattgggttttagcagaaatgaagcactttccttccttggggaacaacatatgctggcatcgctaagtgtgtggctgcctggctccttggtacacaaggactctgtaggaggtcaggcctccttaggacagcactggagactctatactccaaaagtctctccacctggcctagagggtatgtttttagtcctcacaggttatgctattccagatccttctccagccttgacctccatagagaaaatcacatgacacacttcaataaactcaaccacctaagggttcttgtggttcttgaccatacagaccaaccacctccagcaaatctcccactagcaaaaagcaacttatctcttccatggatcttcctcggatttctaccatttcttatctaaggacctcttatttcttccaaagatctgtttgtgtcataaaagaaaaaacaccccaaaacccaattatggatggttgtgaaaagccatgtcaaattaaggggatcatcaacaacgttttctacagttcacataggaggcgatcgggatgctgttcagtcacgctgcaacatctgcctttcattatcattatcgtcctcacagagttcttgagcccctgagtttacggctttctactgggattttaagaaatacacagagatgtatcaaaagttgaacctgtgtatttacagagaatctcagagaaaaatctcttccgtatgataaaaggcctagggacttgtactttacagaatacaaatctaaagaagagatattatgtgccttgagagcttgttagaaagctagatgttacacttttcttctcttggaactactgaatgtagattatagtctatattctgaggttttgtaggtttctcttttgcattccaaagcctttaattctgtagattaaaaaaagaagttaatattagatgttcctagtcccctttaaagttacttacgatttctcacttgccaattgttgaattttcatgtttatttttagtgttgaaaatagggaaactgctatctgtccttcacttcctgccaccttagggaaaagtgaacaaagagtagagaaactacagagacagggaagacagcaagacagacagagtgggaaggggccagagcatatgttttaagtcattcaggcctagttcccatgtgagttttatcacttagtgagtaaacttgagcaagttcattaacctctttgaaactcattttcctcatttcaatcaccttgcaggagctggtctaagggtatatagcaatgcaggtaaagcacttggcacaatacagaaatccaaactatgacatacaggatgatggtggtggtggttaacaggcaaaagtggcaagacagggcagagaaggtgaaggtagcaaagtgagaaagaaatactagatatggttttccctaaaatccaaatataagcatgattgagagtatctatggcaaaggaaatattctaccaacctgattaacaacttcattctgctttgaaagacactcaacctggattgcaaattccatgagaatcagcagactagctaatctcatttcagtttatctccacagtaatcaataattgatcccaggggaaggtcagcctagtgtccttaggtgactcttcctttgccaatttgttttgagctctctttatacaagagtgtaggtattatgatacagagattatttctttaaattggagatgcatctgatgacacttggagaaaaccatctaaagatcaccaaaggaatttaccaaaaggtaaaaccatgaataaaaataattttcagacatgtttcataggactacagttcaactgttatatattacttatgttcttaatagtttggaaccacttgtcagtcaaaattaaatcataggcattccatttgtagaacaaattagtcaatcttatttgcatgaatcacaaaattcttacagctcttcattttcttaaagtatttaacaccctccccattttctcaacgtgaatatcagggtacattagtcacaagaccataacccaattacttaaagggcatattacataaatgattacacaacctgctgtgaaatactgtatctttagcatttggaccacttgggacattgagaggaaggattcattaatgaagtgtgaagctcatttttatttatagtccacaggaaaggcatatttcacagccatcagaagcacttctgcaggcaagaagttacagctaatccaagtgctataccaagctagtacaagtccaatcctggtgtccctggcagtcagaaatgttgtaaaggggaaaggaattttataaaaaaattgatagcacaaggagtatgagaatgtagaagatcaaatccagaccacagccgaaaccttgataggagggacacatgatgaattagcctataggctgaaaggtctggaggaagttgtgatggtatgggtcagatatcttccacttcctctgtgaagtagtagaaagtcattttttgagaaagcggaagtggggagagtggtgacttgaaagagtcactttgggatatggtagagcaagttaattgggaaatagcggataattaggcaatttgaagttggtgactatgaactttgagaagcatcaaatctctcaatccatttctgtcaatttaccctactactgaatgatttaattcattttgtgtcaccagcacctagcacagctcctggcacaaggtagatgctcatatttgactcaattagaaatggcaaatatctgaattgtctgaacacaaacagtaaatggtaaataaatactggccttcttttaggtttgcaaaacacaattgatttgatagtgaaggccaacatatacataaagaaaaaccagaggcctcgattttacattcaaggtaggtcactggtacacaggaagccagctgaggagaggtacaagtgaggggacgtgaggagcacgggtggtgagtatgagatggctgcccagtcacctctgctgaaaaccacctttgagagtagcaggattctagaaacaggatcaaaagaatcagtgtagcaccatatatcactgcctctgtaagaaaactgtgcttgtcaacctggagtttggggaaaagctttaaaggaaacctgtcattctgtactccagcttccaactttgcaaaaggcacttttccttggaactcaggcagaaaaataataaatcacgcctagctctcttgctcaggatccagtcccggttccccacctgtagttccctccagctgcttcctgctacttccattcctgcaccttatgctccagctattccaaagtacttcctggcttaaaacaccaagtgatgttgtaagtcccaagctttgtaagtgatgttctctctcactggagtcctttctctccccagccccttccattataaattcccactcctcctcctcagatgtctcttcttctacaaagcctgtcccgcccctttcacagagtaaagaagcccacccctactgtgtccctgaacgtggctttaggcatggaagaaactacatttaacctttgttccccataacttgaaaagcaactggcacatcatagattctcaatgcatgtctgttgaattgagttttactgttcatctaccttgcagacaaatggcatttcttagatatcaattctttttgatttcctttttccaacccatggactataactttttttttttaactaatttcaggaacacatacgatgtatgcactactggagtctgaataaaatttctaaaaagtagaaataatttaaatgaaaactgatttctttattctatcagtttttgaactcaaactgtctagaaacaagaaggttcatattgatttaaagatgtataaaatataacaaaagacatgcgggttatggaaataagactgttcattctccaaattcacaaatattagaattaaaggcacccctgaaagcctgaagaaggtggctgtagaataaataaaaggagtgccactttacacagcaggtggcaaacatgaaacgttttattgtaagaattggtacagacttgaaagtataagtacgttccaaggaggacttagctataatctaggatgatggttccagcatgtcactgggtggaaattagagctatttactttgtcagcagggcatgcccaccccacacttactcacgaagtgccacctgtatctttgccactgtagctggagcaccgagcaagatacatccagttggtctgatctaactcagcacagcatttctggtgcttttatactctctagaatcatagctatgttgtttggagaaatttattttcttgaaataggatgcagttctttctttgattcatccaacgtaactctcatcgatcttttaaaataaaatatcttccaaaatatttacttcattgaacaaatacatgagggaggtcaaagagatatattgcataccccacccatctgcatgctgaatgtctttctaaaccatcaacccttgagaagggaaaggctgagttaccaagtggactgaggtggatatgtggcaattggaaccatattgaaccatgcaggaaacaaaaagaaaagcacagaaagaacttatctggaactaaatagcaagttcggttcacaaaagttttattcacaagtttttccatgtgaagaccttaaaattccactcaataaacatgtttataaaataagcacacaaacagcctggaaacacatgttagcattatataagaagtagagaaagacaatgaaatcagtcctgtcctccttatgctaattttgatttaatgtctctagggacctgtgctcatggaagaaaatcaaggaacatcttaacatggaaaacaacagaaggctaaacttgtggctcagcacaggagagggtagtagaaaacctggaattgacgccctcttgaaggctgccaatgtttaataacccccagagcccattgttgtaagatgtggctaattctagcagtagttactcataaaagacaagggtataaatctggaaacctaagataaagactatgaagaaactctgaggagaaagagattggtcgtaagcaagcgtggaagaaaagtggcagccagtgtggaggaaggaggggcagtatgtgagtggataggctggggctatgcatatgagttgtgttctctttgctctgtacaacttcacttgccctcttaccactggggtggaagaatagcagcaccagcccaccttcgtagcagttatggggtatatttggggcagagctggaatctgggctgcattgggagaagattagcctacccctaaacggttcctccacctcactgtccctctccacagcccaaagcttaggacttgacaaccaagtagcaaactaagttgtaaaaagagagcaggctcagagcagaggcatagacagttttacctaagagcagagtttcttataaagaggcagcaaatgctaacctcaagtacaggctttggtgatatgaactctgtgtcctggggcactccatcaccctcctcttcttaaactcaccaggaatgacaaagactaggatctggctctggctcttcctctatatgactgatacctgaagcagacaaagtgggatagggttcaaggcagcagtcatgatgagaggcaatacactgaacaacttacacccaataaatcagaactaatgaaaacgagaaatcgagaagttaaaataagcaaaataaatgtcatcaaagagggaagagagattattgataacatgaagcaggaacaagaagttataaaaatctgaaaagaaaaacaatatatgaagaatataaagttgaaacaacttcctagatggaataaatagcagaatggatacaaccaaacaatgattgagagcagatgcagaaattatctcataaggtattggaaaagaaaaaagatataaagtgtaatagttaagatctgtggaatatacaagtgtccacatctttttaacaacagtctcagaggagaggataataaagcagttgaggaaataactcctgaaaatttctatgaattaaagaaaggggaaaaactatagattaaaggtctaacaaggaaaagaaggaagagaggaagggagagagggagggaaggaggggaaagaacaaggaaatgagaacaaataagaaagaggagaaagaaaaagaaagaaaagaggatggggagaagaaaggaggagagaagaggacaaaagaggacaggagagaagagagggaaaaaagaagtcaaatgtatagaaaagaatcaaggactaacagactacactgaaggttcttaacttgttttggtgccatgaatcactttggcaatctggtgaattctatggactcattctaaaatgaaaaaattttaaaaattgttattaattgcataacacaaaatacataagattataaataaaaccatttatgttgaaaaatagttaccaaaatattttttaaaaaacaaatttatgatatagtaataggtgttctcccttattaatgagaacacaacaagacttagtggatggtctaatactgtaattttgaagaaccacagccaacccattttatcatggatgaaaaaaatatacattgttgctgacacaaaaatgtaagttggttgtaactgcagcctaaccaagtattaatgataaacatagctacatggataaaagtagaaaacaaagcaagatttatagtacgataccactgataaaaattaaaaacacattcacacgcaaaacaataccacagacttaacaaggttacacacattatgtaaaacaattacatcaaagacaccaaagtgaatgctaagggagaaaagggaattggagcagtgatcagagaagatgaaagagaaagaaaataagacaagaagaaggctttgcaccaatcagtgatggcaatgtgctctaaactaaggataatgattaacataactctcagtacctaagatctaattaaaacaaacaaccccatcaaagatgggtggaggctgaaagtcagacattattggcatttgagagaatagaaaaaaaattacaagatagcaactaaagattttatacaagtaaacccagactttgtcagctctaatagtcctaaaattgctgttttcagagatgtccttaccccacctcaagagagtacaccattgagaccaggtcaggcataaaagcctgtcagcctagagaggacatggaatagctctcagaactgtcctaatctgaaaggccagccacaaattgtcttttccagttcagacaaaggacatcctcaccgtccactctcttgtcagtggagacagaaaaaaactcaggaatccaatggttgtccagacatttgggtgaagacatgacattccatttgtcttcaatcattactgccgctataataaaaataccttagtctgggtaatttataaacaacagaaagttatttctcacagtttcaaaggcagggacgtccaagatcaaggcaccagtacattcagtgtctcgtgagggcttgattgtgcttcaaagatggcaccttgctaatgtgtcaccacatggtggaaaaggagcaagggagcctcttttataagggcactaatcttatccatgacagtggagccctcatgacttaatcacttcccaaaggccccgcctcttaatactatttcatcaggtattaggttctaacatgtgaattcgtagggggacacaaacattcagaccatcacaccatctataccaaaaaaaaaaaaggctgaatatgctctcctggtctttttactgccccctagctgtaggtggtagcaataaacaactggttgttttcattctgtttctctatctgcctcaccacctctagaagggccctaacttaagttggagtgacagcatacaaaactctccaagcaagtcctcttggtcccccaatatgccatgaagcatgctccccaggagaaagcctgtatggaaattacgctgatgcattcctccttgcattcaggtttggtaagagcaggctgtgtgcaagtggttacagctgctcagtggaccaggctgtggaaaacaaaaacgaaggctttgatttcatctctcccgggtattctccacatcacttttgttgtgtgcgaactaataataacagatctgatctacatacagttcttcttgtctaaaattactcatttaaattaagcattttagtcactgtttgataataagatgcaaggtaaagtacttgtgagcacagaaaattaatagaaaggaaacactgagcgtatgttgagtttagccaccagcatctatttttaaagatgacctaattaattgttacatagaatgtcaggagaaaagaaacactggcaaagcttttagacaaggcaactactaactttaaaagtatggcactgctgaaacagctgtataaaagcttgcagcatgatttcaacacagttgtcaagcatgctggaataaatacatggcaataaaaagccatgtaaatttctgggagaaaaaaaaaatgacaggactgaaagttgaactttaaaaaaattgtaatttttaaattgtgtgtatctccttaagataatcctcatttagtaaatcatatttacagtcattttgccacaggcttttcttccctagctatacatgtatacagcaccatgaagctttacactgtttttcataagagttacggttatttaaatggcaaataaaccaaagacaaagacttggtttttattaaattacagcatcctaaaatttaaacaaaataatccaaatgctgaattcctccctgaaaaactgacataaattgcaataaaacatgctcgcaaaactgaagcatcctactttattttcacaaataaaaggtgattctgaaaattgacttcacttctaaagtaggaaagcaaaactaaagaataaatactgtaatggaatgtaaaagaatatgtttaatagagaggttttataaaagcattgcctaagcataagaaaactagaaaatggtattttaaagactattaacatacatctctttcaagaaaacactaatctaataccacataaaaggagaggtagcatatatacacctacttagattaaaccccagccaccaatatacactctgaggtctttataacccctccttgcaaaaaaggagggtgtttgattagtgagtttaccaaattcacattaactgggagtggaaacctgccaacgggacttgcagggttgaaggatagaagaaactcactcatgtcatgtccctctatccaaatttaataagataaacaaaaactagcaaataaaaattaaaacaaaaactcaccaacaaatagcaaacaaagaaaaagccacaagccaaggccattacctcagaaaataatgggtgaggaaaaacaaagaagattccagagcagagcagggcggcctgtgtaagggtgtaaggaggctccatcacgcgcgcgcacacacacacacacacacccctcacaagttacacagcagagctgcaaaatcctgcaccctcacatcaataatggatctggaaagaggcgaacttagtagggtgggcctttttcccttttctggggagctgtggaagggatgctagggagaaaaaagcagttttctggcaaaagagaagcctctaggctacaggatgaattgagggaggatcagaagcaagtggggacgcctccagggatagaggtcacccccctccccccgcccttaggtgaacatttagcattacctctctcagaggtgagaatccagactaactcctgcacccacctcgactgagctctctggctcccagcctattcccaggaaacagaaaagtggatcaaacaccaaaaagcagagcctgagtggtcttttcttagtagaaacaagagttctcagattagaagagaaagacagtcaaggacgatggttatttctggatgatgggattagaggtcattctttttactttcttctctgtactgttccgagttgcttaaacattctttatcatacacttaaaatttttacttacaacaaaaacaattttaattgaaagaagaaacgcgactatacaaatttttaagaaccatgaacctgaggtaggaaaacaacaaactacataatgttcctgtcttcacaagataaatcccacctgtgtggccctttgatctttgagagaagagcaaagaaggaaaagaggagggaaacatcaagatttagaaaaaacaagatgcacaaaagaggaagctgatctgtgagatagggaggtccaggctctactggaacagctggagagatagaatctttcttccagtcctagattttccctcccatttccagcctatactcctacaaattgattcttccatcatccaatcaccaccaaaccctgacactcagtctcagtcagctctagctagggaagcaattgcagggggctgatgtgagaattgcattactttagtgcatgtgtgtccatgcatacacttatgtgtgcgcatgcatgtgtacagtagagctgctgaagcaaaagacttattccaaacatgaacgatgatatctgaaagaaaatataccttctttacttgaatgcactttttctaccaaaaaaactattaaataactaatttctataagacatgaataaagacaactataatgacaaacaagattcaaagggtaccctagaacttaaagtataataaaaatatatgtataaaaaaagatttaaagggtgcatcagcagaaacacacactattctgtcactgtttaccctatttcagtggatttaaggatcactgattatacgatgtacccttattttatgtgctactatgagagaaaaaaaattatcaggtaaattataactcagtacttcctcatcacatcaactgcaagacacatgctgatcacagggatgttagagtgaacacaatggaatattactcattgctcacacacctgtcaagatgtgtgatccttgatgggtcctttaactcttctggttatacaatgttgaactatatagcatttgtaagatcctcttatgttctgaaaattctgtgcttccaggtctgtggttttctcccagaactaagatattttggagccctggggccttccaggccacaaagaacaggagctacaggtgggatctgtggtttggaaagactaagaggctccaagcctttggggcagccccttcctcagctctaacaagaaggcaccagtgaaaagacagctttcctccctcagccaccgcctctctctcacccatacctccgttcagggctttttcccacttattcctatttcttggttcctcttttcccaggccagaagagaaagcagcagaaaggaagatcccaggcctttttcttccatctaatcaagacttcaggatggctttcttgcagtcagggaatggttgcctgggtaaccaagtattaactataaggatctccccttctctctttttgctagactaaccattctggtttctccctcctgtctgagtagggagttaatagtaaaaggatttatttaactaggctctggattttataacccttgctggcttccaacagcgaactccaaactgccttttactggaggcttgtcttaaatgaaccagaactactttttctcatctattattttaaacctaattggaacacagcaaagcgaaacaagtttgaaaggcagtcagagtagcttccctatgccatgatttatcaatgtctgaggctagcatattaaaatatagctcttgttttgtaccatcaagattggatgaaaataagaatgcctttagaagggaaagggctttcttaaccaaaatatctaactctactccttatcactgttcacagagtagattattgtatttagttatgtggatgatgggtggggcccaaagaaatagatccggggtctggggtacagtgtggtaaatgcaagcctgaaaagatatcttcagaagaaggtgtgtaacagagggataggggttgtagtaggctgttcttgtattgctataaagagatatctgagactgggtaatttacaaagaaaagaggtttaattggctctcagttctgcaggctgtacagggagcatagacctggcatctgtttctggtgaggcctcaggaagcttatcaggcaggggccataacagcctgcccttctctctggcttcttgttgagtttaatcagtgcaaaggacttgccagggatgagaaagtaggaaagacaaattgagttacgtataacaccctctttccctgctgggttggcagtgactgtttctctgctgaaggccacagctcctgcctggcagaactctcctacaaatacaacctccatgggtttcagcagcttcttcaagcctaggtggtagggggttccccctgtaactagggcatgggtgcttcaccatcccatgttgaattcccttaattccttttataaataaatccttccataaccactttcttcagaattatttatccatgtataagaatgatactgtgattattttttcaagtgggctttaccttttagagatacatcctgaagtatttagggacaaagtgatatttaaatgaagcgtgtttggtcatgatttgataaccgtcaaagctaagagatcatgatttggtaatcatcaaagtaaaagcgttcagggtctttataattttccctctacttttgcacatgtttaaaatttttccatcataaagaaattttttaatgataaaaaaaatgtttaagcacccctttgggagatgctgtttcccatagggacctggactgacacaggagcagaggaggaatgagcagagaatatcagcaagatgaatgatatagtttggataattgtccctacccaaacctcatgttgaattgtaatccccaatgttggaagtgaggcctggcaggaggtgattagatctggaactgaatttctcatgaacggtttagcaccatccccttggcactgtcctcaggatagtgagtgagttcttgtgagatccgatcatttaaaggggtatagtaactcccccctcactctcttgctcctgctctggccatgcgatgtgcctgctccccctttgccttccacaatgtttgtaagtttcctgaagcctccccagaagctgagcagatgccagcatcatgcttcttgtacagcctgcagaaccatgagccaattaaacctcttttctttataaattacccagagtcaggtatctctttatagcagtgcaagaacgactaatacaataacaatggcctacttcataattttgcctggagttagccctaaaagtaaaggctgcaagtgatgtgtttgtggtcctttctgaactgggactagacagtaaaatctcaataattcactgtaattaggaaaacaattcaatctgactcagcaaagatctgtattataaactatttcttaaattcttttgaaacttgaacaatgtattcattcagtttggactggccttcacacacacagactttggagagttccaatcttatttctcagcacaccttgttggaaatctttataaaaacctctttcatagccatcgtaggcagcttttcctcacactatcatagagtacctggccctctctccacttcaaaacactcatctcaaaatttagcttgtttcacctctcctttaaagtctgtcttaaccatattggcccaaaaggaactcttcttagaaattattatctcacctccaccaatccctaggtgaccttgggcaagttacttaacctctcagacctcagttttatcatctgcaaaatgggactaataacagtacttatttattagaatttatatcagtattgaatgagtctgagattggctaatactaggcattcagtcaacgttaggtactatattaccatttattcagcaaatattccactatatacctggttttttctaagtcctgaggatgtaacggtgaaaaacataaagcccctgccctcatggagcttcctttctagcaggagaggcagataataaacatgtaaacagatatatatatatatatatatatatatatatatatatatatatatatatatattcaggtttcaactagtgctaaatgctatggcaaaactaaaatgagtaaaaatgatggaaaatatgatttttggtacagtggactgggatgccctttctaaaagggtgacattttgatgataaaacacatattgaaattagtttttaagctcattttactgcctaaaaagccctcttaaatatatatcaaaagctttcaaatatttgggaatgatatattttccaactcagtagccatgataatccagaatcccaacctgggttggcagactcatcggtggacaagttcacatcgtaaaccttcagcatgcattccaaacctgccttttcctttcattttaaatgttatcttcctcatgttgtcttcctaatactgacctaatttttcaaacatggtgctttgtcaccgcaacttcttcacactgttgacagagtcttctcttgctgccttttcacaaaggtggccttttactttcttcacctttgtttcctaagaaattgcccacagcctgccttacacctttaaactggtttcatgccactgttcagctgttttccttttatatcagagtcactgtcactgaattattccacctctttactccctcttctttattctctttgctgccatatatagccaaagtgaaaggagatcccaaaagaagctgctaactttggggaggtgtgtttttggtactggtaggagtgggggaatcagagaaatctgggcatgggagagttgaagcaacatgatccaagagctctgacatcagttttctgacaatttcaaaatctgtgaataaaataaggatgtgtgttataaagtatcaggagaatcaggaagataaataggatgctttttcgcaagggaaaagaatttctactaatgaaaatcatcaccaatgactcctttgtaattgggttaatggaatgattttaaaacacacacccacctctagctatataaaataatacaggatactttaatcctgagatcctggacttttcccactgtgaagcaataaatataaataaatatcttggcttaacattcctctttacctcctgcttcttctctctggtgattttttttccttcttctttatgcacaaggccccagatcactcaagattagaaaacataaaaggctcagaaattaaattcttaagattaaggaattcacttaagccacataaatttagagcctttctttgccagccaggaactcagcaactcagattaataaacctcgtttctgaagttgtgataaatgaaggccatacaaaatcagccaggttttcagcttgttgcagggtccacatgagtgctgggatggagccatcaaccaaagattggctcatgcacaaaacattccaggagccaggaaaggcggcgatgggactgaacacaaagctctttagtatgtgcaacaattaatgttttaaatattaaaacaaattaatatgagagagaatgttgctttcttataacaaaaactcaatctcatctcacaagttaaaatattacagagaagaaaagatacctgaaaatgctagctttttgcactctcacatccttatggagtcctcttatgaaaatatcctggattgttctagtttaaatttttttaaaggatctgaatatttgttcttaaataacttgtttaaactagtattggtcaccttcaagtgccctctggtgtaacttattttaatcttccagacaatactttaccctgatcaaaggaaaggattctttttttgctccttttgtgtttggattaaaaattatgatctgcaagcatgagttgaattaaattgaaagtttcttcactaagagtaggaaatcactaactctaaaacatccttttaaaatctgggcatagaaggtttagagtctggcttcccagtgtggctgaaggtggaaagtgggggcaatctgcaggcaaaaaggaggcaccctgtctgtagagaatttacaaacataacaaacactttatacaagtaataaagttttaataatgaaactgaccaaaaaccagtctgctccttatcatcatgtacatgccaacaattctaactaatataagtgataaaatgctgttccctccccaccaaaattttgttgtataagttctaacaattgttgtggttactgttgggttttaataatatatatgcaaactttaaattagcacgtttttactgctcatccttttatacaggcatacgttttattgcactttacagatattccatttttcacaaatttaaggtctgtggcaacctttcatcaaacaagtctatcgctgtcatttttccagcagcatgtactcacttgtgtctctgtgtcgcattttgatcatccttgcaatgtttcaaactttttcattattattatatcctttatcgggatctgtgatcagtgacttttgatggaattattataattgttttggggtaccacgaactgtgcccatataaaatggcaaatttaatcaataagttttgtgtgtgtcatcactgctccactgatcagccattcctccatctccctccttcttctcagacctttccttcctattccctcagacacaagattaaaattaggccaattagtaaccatacaatggcttctaagtgttcaagtgaaaggaagcctctcactataaatcaaaacctagacttcatgaaagacctaaaaccatgaaaaccctagaagaaaacctaggcaacaccatttaggacataggcatgggcaaagacttcatgactaaaacacaaaagcaatggcaacaaaagccaaaattgacaaatgggatctaatgaaactaaagagcttctgcacagcaaaagaaactatcatcagagtgaaaaggcaacctacagaatggcagaaaatttttgcaatctatccatctgacaaatggctaatatccagaatctacaaagaacttaaataaatttacaagaaaaaaacagccccatcaaaaagtgggcaaaggatatgaacagacacttctcaaaagaagacatttatgcagaaaacaaacatattttaaaaagctcttcatcactggtcattagagaaatgcaaatcaaaaccacaatgagataccatctcacgctaggtagaatggtgatcactaaaaagtcaggaaacacatcctagagaggatgtggagaaatacgaatgcttttacactgttggtgggagtgtaaattagttcaacattgtggaagtcagtgtggtcattccttaaggatctagaagtagaaataccatttgacccagcaatcccattactgggtatatactcaaaggattataaatctttctactataaagacacattcacatgcacacatatgtttattgcagcactgttcacaatagcaaagacttggaaccaacccaaatgcccatcaatgatagactggataaagaaaatgtgacacatatacaccatggaatactatagagccataaaaaagtgtgagatcatgtcttttgcagggacatggatgaagctggagaccatcattctcagcaaactaacacaacagaaaaccaaacactgcatgttctcacacataagtgggagttgaaccatgagaacacatggacacaggaaggggaacatcacacacgggggcctgtcgggtgggggctgaggggccaggggagggatagcattaggagaaatacctaatgtagatgacgggttgatgggcgcagcaaaccaccatggcacatgtatacctatgtaacaaacctgcacgttctgcacatgtactgcagaaactataaaaaaaaaaaaaacctctaacttttaataaaatgttttatttatttctatgtggaataaaaatcaaaaataagccaggaaaaaaaaaagctagaaatgaggaagcttaatgaggaaggcaaataaaaagctgagactggccgaaagctaggcctcttgcactaaacagccaagtcgtgaatatgaagaaaaaattcttaaggaaataaaagtgctacccagtgaatatatgaatgataagaaagtgaaacagcattattgctgatatggagaaggttagagtggactggacagaagatcaaaccagccaacacattcccttaagccaaagcctaatctacagcaagatcttaactctcttcaattctatgatggctgagaaaggtgaggagccagcagaactaaagtttgaagcagaggctggttgatgaggtttaaggaaagaaactatctccaaaacataaaagtgcaaggggaagcagcaagggctgatgtagaagctgcagcaagttatccagaagatccaactaagatcattgatgaaggcagctacactaaacagattttcagtgtagctgaaacagccttctattggaagaagattccatccaggattaactagagaggaaagctcaatgcttggcttcaaagtttcaaaaggcaagctgattctcttattaagggctaatgtggctggtaactttaagttgaagccaatgctcattgactgttttgaaaatcctagggcccttaagaatgatgttaaatctacattgcctgtgctttataaatgcaataacaaagtctgaacaacagaacatctgtttacagcatgatttactgaaaattttaagcccactgttgagacctactgctcaggaaaacagattcctttcaaaatattattgttcgtagacaatgtaactggtcacccaggagctctgaaggagatatacaaggagataactgtgattttcatgcctgctaacacaatatccattctgtagcccatggatcaaggaataatttcaattttcaagtcttattgttaagaaatatattttgtaaggctatacctaccatagatagtgacttctctaatgaatctgggcaaaatatgtagaaaaccttctggaaaagatttaccattctagatgacattaaaaacatttgtgattcatggaacagacagttctcaaaagaagatatacaaacggccaacaaacatgaaaaaatgccccacccacatcactaatgatcagggaaatgcaaatcaaaaccataatgtgacaccaacttactcctgcaagaatcgccatactcaaaaaatgaaaaaataatagatgttggcatggatgtggtgaaaagggaacacttttacactgctggtggaaatgtaaactactaaaaccactatggaaaataatgtggaaattccttaaagaactaaatgtagagctaccatttgatccagcaatcccactactgagtacctacccacaggaaaagaagtcattacataaaaaagatgctttcacatgcatgtatacagcagcacaatttgcagttgcaaaaacatggaaccagcccaaatccccatcaatcaatgagtgcataaattgtgatacacacacacataccatggaataccactcagccataaacatgaagaaaataatggcatttggaccaacctgaatgggactggagaccagtagtctaagtgaagttaagtcaggaatggaaaaccaaacattgtatgttctcacttataagtgggagctaagctatgagaacgcaaaggcataagaatgatacaacggactttggggactcaggggaaagggtgggagaagggtgagggataaaaaccacccactgggtacagtgtacactgctcgggtgatgggtgcaccaaaatttcagaaatcaccactaaagaacttattcatgtaaccaaacaccatctattcccccaaaaacatattgaaataaaaaaaatgaattaaaaaaaccattcgtgactcaggagatcaaaatatcaacattaacaggagtttggaagaagttgattccaaccttcatggacaacttggagaggttcaaaactttggtggagtactgcagatgtgatgcaaatagcaagagaactagaattagaggtagagccttaagtatgactgaattgctgcaatctcatgataaaacttgaacagatgagaagtcgcttcttatggatgagcaaagaaagtggtttcttgagatagaatctattcctggtgaaaatactgtgatcattattgaaatgacaacaaaggatttagaaaatgacataaacttaatttataaagcagcagcagggtttgagaggatggactctaatttttgaaggaagttctaacgtggataaaatgttgtcaaacagcaaagcatgctacagagaaatattttatgaaagagttaattgatggggcaaacgtcattgttgccttattttaagaaattgccacagccatcccaaccttaagcaaccacgaccctgattagtcagtagccatcaacatcaagtcaagactcactgaagccttagatgatcattagcattttttagcaataaatttttaattaaggtatgtacattactttttagacataatgccattgcacatttaatagactataatatagtgtaaacataacttttatataaactggaaacaaaaaattttgtgtaattcactttattgcaatattcactgcattgtgatcatctggaaccaaacccacaacatccccaaggtatgcctgtatatattataatctacaagtaagctaattcagagaaatcccagttatacagctgactccagacacatgcagtcttggacacacacatatgtgttccataagcaagtttgtgaaggtttgggaatcattccagctcacttcgaaaaaacttatgatactccatattctgacatttaaacagaagattcaaaataaataattataggatattacttgcaaaaaaaaaagaaacaagtaaattcatcattccacatgattaatggaatttttgtttttaaaaatgtaaagtgacgaaatgaagtacagaatgtgagatgtagtatttttattggtaagtgtaaactttatacatgattttgctaaactttaataatatctttaaaattgatatttcttttgttattcttgtgattatttaataaactttaatattatttattactgtcataaaccaataattggttctttccctttgtgcaaaaatttatactaatgtaattaaaattaccaatccattacttttttccttttatgtacataacattttttatgtttctttactttttaaaagcataattatatatatgaagtccagtaaaaaatttccacaatttggctgggtgtggtggctcacacttgtaatcccaggcctttgggaggccgaggcaggtggatcatttgaggtcaggagttcaagaccagcctgaccaacatgatgaaaccccatctgtactaaaaatacaaaaaaaattagccaggtgtggtggcacatggctgtagtcccagctactcaggaggctgaggcaggagaatcacctgagcccaggaggtggaggttgcagtgagccgagatcatgccattagcactccaggctgggtgacagtgcgagactccgtctcaaaaaaaaaaaaaaatccacaatttgtatttcctttatggccattattatgcatattatatattattcatataaaataatttttaagataattttgtcacctaaaggaaggaggattaaaacgttatgtgctctgagtgcaaacatgctttgtaccaacatgctttctggagttttctcagattctttgactttcttactttttgtctcatacaagcttgcatcaaaattgtgagctggcttaagatggtggattataggaaaactagaagaaaacacttcctagaaaggaatagaagacaagtaactaacatgcatttattcgcccctttattcattcaacaaataactattaaccatctaccaccataccaagcactggtctaggcaccaggaatattatttcatgccgtctggaaggttgccttttaatagaaaaacacagacaaataacaaacataatgaacaagtaaattatgtaatatgttagaatgcagtaagagctatagaaaaaaataatgaattcagcatgataaacgagtgccaggacattggagttttaatagggtagctattggttattgggaaggtatcttttgatcaaagacttgaataagttgagaattagccatgtggacatctagggaaagtgtattctgggcagagaaaaccaaccagagcaaaggtcatggggaaggggcatgcctggatcgttccaggaaaagcaagaaggacacgaagcagagagtgaaagggaaagaaaggagtagtagatgaaattagagaggtcaggaggatcagattgtacagagctttcttaaacctttaaaacgactttgtcttttactctgggtgaaacagggaaccactgcagggctttaagcagaggaatgacatgatacaactcatgatgtttaaaacagtggccttagtataagtgggttgactaccttaaaagccctccaatcttcctggagcgatatggggtggcccacctaagacatctgtccccattcatcaccaagattgatccgtctgatctgactgactaggagtaccattcttccctgccttcttgccttgcatcgtcctaaaggcgcacacctggtcaaccctttcagatttaggagaggcattcttcaggtaagggtctagaggtgctacctgatgctaaaactttgaccatttgagattatttttcacctactatcttcaagactcttctgtaaaactataaattgctcttgaattcttaacctatgaaaactgactttttgatataaattaaattagcccttaaccgacaattaagcagataactgacaggtgggaatgaacaccagaaacattcacagcaacacacacacgcacccctagacctcaatatttagatattcatcatacatacattttctatccacaattgactacaatgctaatagttctcaaacgtacacaagatgtacgtaatgtcctgtccatttgtttccctctttcactgtcataactgaacagggattattggaggatatagtgaaaagaagggcaaactcagatgttgtgcatggcagccatgctaggaagtaggaaaagtagaggcaagaagacccctggagaaagatttgtctgcctaaagtttgaaccaaagccagcttctacctcaggccaacccattctctgaacagaaggaaaggatgcttcctgaggtactgacctggcctatgaactttaccctcaggagagctgaccaaaggatgtctcctggtagcctaattggtcctcttggtcctcaaattctcttttttaaaaactattacattcattctacctatgcgttttttcaataaattgtattaatatttcttagtcacaatagaaggcttttaacttctcaattatttttcagtctcttccaagggtagtactatcagaagcaagatgaaaagcatcaaggtgggtaccaatttttacccacacttagcaccaaaagttgaatttgaagctaggattgggcaaatacaagaatgactatttcctaaccatgtataaaaagctgtttcaaagttttctctgatgttcataaacatcaagtatcttaccagtaatcacagttctaagctggtaattttccagtacgtaggcttccatacttctgaagcctacatgtgaatgcttatattacaggtgcttctttcccttaaggtagtcacttatgggaacagcttatggacaaacagggagcttttgtgttgagtgtaatagatcagcctctctttcataaatgacagcttctacccagattagttttataaggagatggcaactccctatttgatataattttacatgcactagaaagttttccttgactccatcactcatgaagcttacccacctaatgaaaaaaatgtctaatgataaaattagacagcatgcaagaacagatgactaatgtaaccaaaactatgaaaagtcttagaatctaaaggagatgctagagatcaaacactaacagaactgaatatgccttttatggactcctcagtagactgaacatggctataaaaagaatcagtgagcttgaagatatgtcaatataaacttcaagaactaaaatgcaaaaagaaaaaactatagtggaaaaaacagaagaatatattaaagaactgtgggacaatttcaaaaagtgtaacatacataatttgaataccagaaaaagaagaaaaagtggagcagaagaaatacttgaaagtaatgacaaacacaaaaccacagatccatgaggttcagagaaaagcaggataaacacttaaactacttgtaggcatagcatatgcaaactgcagaaaaccaactacaaagagaaaaccttagaagaagccagaaggaacaaacactttacctatagaaaaacaagtttaagaattacagcagacttctcatcagtaccatgcaagcaagaagagaatgaaatgaaatatttaaagtgttgaaagtcaaaaatcaccaacctggaaattctatatctagcaaaattgttcttcaaaagtaaaagagaaggacttccttcatgcaaaaaataataataactaccctgagggaattcattaccagaagacctgtaatgcagaaattttttaaaaaacattatttaaggggaatgaaaatgatataggtcagaaactcaaatctatgtaaaggaaaatcaatacagaaggaataaatggagatacaatcatctgataactgtttacttaaaataataatagtaacaatgtattggttgattatagaatatgaataagtgaaatgaatgacagcaatgtcataacagataggagggagaaatgagggatactgttatgagtaagaacctgaagtgcagatgcaatggtagagtgttattagaagctggatatagacaagttaaaaatttatattgcaaactctagaccactattaaaaaaatttttaagaaatgtaattgctaggaaaggagataaaataaaatcacatgaagtgctcaattaaaaacagacaaggcaggaaaatactggaacaaaaaaagaaacaaatgcaattattataaaacagatatgaacatggtagatatttatacaactataccaataatcactttaaatgttaattgtttaaaaacacaaggtaaacaaaaaggttgtcagagtagattgaaaaaacaaggtccaaatatatgttgcctaccagaaactaaatattaaaaactcaagtgggatcatcatggcagacaggaggcaggactagattacagctccagagacagcaacgtacagaagctcacactgtgaattttagctccagaacgactgcaattacaaaccaaaaatcccaagaggacccacagaccctctgaaggaagtggactgctcctgcaggacctgggagacaccccaaatactgtgagtgccctaactgcagaaatgggaaaaggagactctcctctcacagggctccatgcagacaacccccagtaccagtccagaccctcaatggagaagctgaaggtctgtttgtgggagaagtttccaactttacctggagctgagtcaatttagagaaccaagtgaaatacaggggagaggaagcagcagaaaggccttgggagcttgctgtgtaccctagcagcccattcctgcctggcaccacagggatccattgggagggtgaccagaggagcaggggataaactccacaggaggaagaaaatctctagctgaactttgtaacaatttgaagggtgggaagcctcctgctcagaagtcacgggagggtgcaaatctggtgtgcagactccacaggcaggggaaaaaccaagcccttttctttcgcagctgggaggtgggtagcccagtgcaagttttctagcctgtcacaccctccgccaggaaacagactcggggctactgggggtgggggcacagtgggagtgagaccttcagtttatgtgggatctggatgaggtctgtgactgctggctttcccccatttccctgacaacctgcatgactcaggagaggcagccataatcctcctaggtacacaactccagtgacctggaaatctcaaccccatcctccacatcagctgcagcaagacctgcccaaagtgagtctgagctcagacatgtctagccctgcctgcacttgatggtccttccctatccaccctggaaacagaagacaaagggcatataatcttgggagttctagggcactgcccactgccaggccctctccatactactacagctgatgctttctggaaagtgtcacctcctggcaggaggccaaccagcacaaaaatagagcattaaaccaccaaagctaagaaccctcacagaatccattgaacacccctgccacctccacctgaacaagcactggtatccatggctgagagacccatagatggttcacatcacagggctctgtgcagacaacccccagtaccagtccagagctgggcagtctcacggggtggctagactcagaagagagacaacaatcactgcagtttggctctcaggaagccacatccacaggaaaatagggagggtactacaccaagggaacacctgtgggacaaaagaatctgaacaacagcattcagccctagatcttccctctgacagaggccacccaaatgagaaggaaccagaaaaccaaccctggtaatatgacaatacaacgctcttcaacacccacaaaaaaatcacactagttcaccagcaatggatccaaaccaagaataaatccctgatttacctgaaaaagaactcaggagtttagttattaatctaatcagggaaggaccagagaaaggtgaagcccaatgccaggaaatccaaaaaataatgcaagaactgaagggaaaattattcaaggaagtagatagcttaaagaaaaagcaatcaaaaattcaggaaactttagacacacttttagaaatgtggaatgctctggaaagtctcagcaatataattgagcaagtagaagaaagaaactcagagctcaaagacaaggtcttcaaattaacccaatccaaaaaagacaaagaaaaagaataagaaaatatgaataaagcctccaagaagtctgggattatgttaaacaaccaaacctaagaataattggtgttcctgaggaagaatagaattctaaaaccttggaaaacatatttgggggaataatcgaggaaaatttccttggccttgctagagacctacacatccacacacaagaagtacatagaacacctggaaaattcatcacaaaaagatctttgcctaggcacattgtcatgaggttatccaaagttaagaggaaggaaagaaacttaagagctgtgagacagaagcaccaggtaacctgtaaagaaaaacctatcagattaacagcagatttctctggagaaaccctacaagctagaagggattcagtctcctcaaacaaaacaattatcagccaagaattttgtatccagcaaaactaagcatcatatacgaaggaaagatactgttgttttcagacaaacaaatgctgagagaattcacctattaccaagccaccactacaagaactgctaaagggagctctaaatcttgaaacaaatcctggaaacacatcaaaacagaaactctttaaagcataaatcacacaggacctataaaacaaaaatacatgttaagaagcaaaacaaaaagcaaaaaaatcaaagcatacaggcaataaagagcaagatgaatgcaacagtacctcacatatcaatactacattgaatgtaaatggcctaaatgttccacttaaaagatacagaaccacggaatggataagaactcaccaatcatctgctgccttcaggagactcacctaccacatacagactcacataaacttaaaagggtagaaaaaggcatttcatgcaaatggacaccaaaagcgagcaggatagctactcttatatcagacaaaacaaactttaaagcaacagcagctaaaagagacaaagagggacatcacataatggtaaaaggccttgtcccacagaaaaatatcacaatcctaaacatatatgcacctaacactggagctcccaaatatataaaacaattactaatagacctaagaaatgagatagcaacacaataatagtggagacttcaatactccactgacagcactagacaggttatcaagacagaaagacaacaaagaaacaatggatttaaactataccttggaacaaatagacctaacagatatatagagaacgtttcatccaacaaccgcaaaatacacgttctatttaatagcacatggaactttctccaagatagaccatatgacaggccataaaatgagcctcaataagtttaagaaagttgaaattatatcaagcactctctcagaacacagtggaataaaactggaaatcaactccaaaaggaaccttcagaaccatgcaaatgcatggaaattaaataacctgttcctgaatgagcattgggtcaaaaacaaaatcaagatggaaattaaaaaattattcaaactgaatgacaataatgatacaacctatcaaaacctctgggataaagcaaaggcggtgctaagaggaaagttcataaccctaagcacctatatcaaaaagattgaaagagcacaaactgatattctaaggtcacacctcaaggagcaagagaaacaagcgcaaaccaaacccaaacccagcagaagaaaggaagttatcatgaaagatcagagcagaactaaatgaaattgaaacaaacaaacaaaaaagataaatgaaacaaaaagctggttatttaaaaagataaataaaattgatagaccatcagcaagattaaccaagaaaagaagagagaaaatccaaataacctcactaagaaacaagacaggagatattacaactgacaccactgaaatacaaaagatcattcaaggctactatgacgcatttacgcacatagctagaaaacctagaagagatggataaattattgtaaagatacaacccttctagcttaaatcagtaagaattagataccctgaacagaccaataacaagcagtgagattgaaatggtaatttttaaattaccaacacaaaaagtccgggaccagacggattcacagcagaattctaccagacatccaaaaaagaattgttaccaatccttttgacactattccacaagacagagaaagaaggactcctccttaattcatcttctgaagccagcatcaccctaataccaaaatcagaaaaggacctaaccaaaaaagaaaactacagaccgatatccttgaagaacattgatgctaaaatccttaacaaaatactagctaaccgaatccaacaacataccaaaaagataacccaccatgatcaagtgagtttcataccagggatgcagggatggtttaacatatgcaagtcaataaacacaccacataaacagaattaaaaacaaaaatcacatgttcatctcaatagatgcagaaaaagcattcgacaaaatccagcattgctttatgattaaaactctcagcaaaattagcatacaagggacataccttaatgtaataaaagccatctatgacaaaaccatagccaacataatactaaatggggaaaagttgaaagcattcactctaagaactggaacaagacaaggatgcccactcttaccactcctcttcaacatagtactggaagtcctagtcagagcaattagacaagaaaaagaaataaatggcatccaaatcagtaaagagaaagtcaaactgtcactgtttgctgatgatatgatcatttaccttgaaaaccctaagaactccttcagaaatctcctagaactgataaaagaattcagcaaagtttccacatacaagattaatgtatgaaaatcagtagctcttctatacaccaacagcaagcaagcagagaatcaaatcaagaacccaaccccttttacaatagctgcaaaaaagaaataaaatacttaggaatacacctaaccaaggggtcaaaagacctctacaaggaaaactacaaaacactgttgaaagaaatcatagatgacacaaacaaatggaaacacatccatgctcatgggatgggtagaatcaataatgtgaaaatgaccatactgccaaaagcaatctatacattcaacacattccccatcaaaataccaccatcattcttcacagaattagaaaaacattctaaaattcatatggaaccaaaaaaagagcccaaatagccaaagcaagactaagcaaaaagaatacatctggaggcatcacactacctgatttcaaactatactataaggccatagtcacccaaacagcatggtactggtataaaaataggcacatagaccagtgaaacaggatagagaacccagaaagaaacccaaatacttacagccaactgatcttcaacaaagtaaacaaaaacatcaagtgggaaaggacacccttttcaacaaatgatgctggataattggctagccacatggaggagaatgaaactggatcctcatctctcacgttatacaaaaatcaactcaagacggattaaggactgaaacctaaaacctgaaactataaaaattctagatgataacattggaaaaacccttctagacattggcttaggcaaggatttcatgaccaagaacccaaaagcaaatgcaataaaaacaaagataaatagctaggacctaattaaactaaagagcttttgcatggcaaaagaaactgtcagcagagtaaacagacaacccacaaagggggagaaaatcttcacaatctatacatctgacaaaggactaatatccaaaatctacaatgaactcaaacaaatcaataagaaaaaaacaaacaatcccatcaaaaagtgggctaaggacataaatagacaattctcaaaaaaagatatacaaatggccaacaaacacattaaaaaatgctcaacatcactaatgatcaggaaaatgcaaaccaaaaccacaatgtgatatcatcttacttctgcaggaatggccataatcaaaaaatcaaaaacagtagatgtcagcatggatgcagtgaacagggaacacttctacactgctagtgggaatataaattagtatagccgccatggaaaatagtgtggagattccttaaagaatttaaagtagaactactatttgacccagcaatcccactactgggtatctagccagaagaaaggaagccattattcgaaaaagatacttgcacatgcatgtttataatggcacaatccacaatagcgaaattgtggaaccaacccaaatacccacaaatcaatgagtagataaagaaagtgtggtgtgtgtgtgtgtgtgtgtgtgtgtgtgtgtgtgtgtgtgtgtgtgtgtatagacagatatatgatggaatactatgcagccataaaaatggataaattaacagcacttgcagtcacttagatgagattggagacgattattctaaatgaagtaactcaagaatggaaaaccaaacaccatatgttctaactaatatgtcagagctaagctatgaggacaaaaaggcataagaatgatacaatggactttggggacttggggggaagagtgggagggggactagggataaaagtctacaaatatagtgcagtgtatactgctcgggtgatggatgaaccaaaatctcacaaatcaccactaaagaacttactcatgtaaccaaataccacctgtactccaataacttatggaaaaattaaaataaataaataaaagctcaaatatgttaaaagtaaagggatagagcacatatcattctaatgctgaccaaaaggaagctggaataactatattaattttagacaaattaaacttcaggaaaaatacttaaataaaggcattgcagaaggtagacaagtatccacaaagacataataatccttaacatgtatgcacatcttctaaagctcacatggaatactaaccaagatagaacattatggatcaaaaaacacattaacaaatttaaaagaatagaaatcatactaagtatgttttcagatcacaacagaactaaactatagatcaaaatcagaaagacaactggaaaatagaaaaaaatgaagattaaacaacacacttctaaataacacatggaatcaaagcggaagtctcaagagaaactgaaaatattctgaacaaaaatgaaaacatagcaccaaaatttgtggtattcagtaaagtagatctaaaggaaaattatggcactaaatgcatatgttagaaaagaagaaagacataaaatcaatagtctaaactttctctaaaaaaaaactagagaaaaagaacaatttggaagcctgtaacaaaaagaaacacaataaaagtcagaatataaatcaataaaattttaaacagcaaacaatagacaaaaatcaatgaaatcaaaagcagctctttgaaaagctcaataaaatttataaacctctagttaggctaaccaagaaaaagagaagacacaaattactaatatcagaaatgaaagaaagatcatcactactgatcacatggacattaaaaggataataaagaaatagtacaaacaactctctgcccacaaattagataaagtgaaccaattcttcaaagacacaactaccaaaagtcacaaaaggaaaagtagataatctgaagaggaccatatctaccaatgaaattgaatcaataattaacaaccatcaaaacaaaagcaccaggctcaaatggcttcactggtgaattctaccaaaaatttaaggaaaaaatgatacaatttccactatctcttacaggaaatagaaataattcctaactcattctatgagtccagaattaccctaacaccaggagcaaataagaatattacaagaaaggaaaactatagatcaatatctatcatgaagataaatgtaaaaatcctcaacatattagcaaatcaaatacaacaatatataaaaataattatacatcatgaccaagtgagatttattctagctaggcaaggctgttttaatatttaaaaaccaatgaatgtaattcaccacattaacaggctaagggaaaaaaaagcaatattacattacttggtacagaaaaggcatttgacaaaatcctatatccgtgtataataaaaattatcagcaaactaggaatgcagggaaagttcttcaacttgataaagaacagctacaaaacacttccttacttaatagtgagaaaccagtaactctctaagatcatgaacaaggcaaggatgtcccctctcaacagtcctagttaacatcatactggaagtcctaattaaatacataagacaagaaaaggaaataaaaggtatacagattggggaggacaaaattaaattgtctttattcacaattttctctgtgcaaaatcccaaaggataggggaaaagttcctggaattaatgagtgagtatagcaaggtcactatagaagaatagaaggttaatatacaaaagtcaattgctcttctatataccaaaaatgaccaatttgtatttgaaatgagagaaaatacatttgcaatggcaccccaaaaatgaaatacttaggtataaagtctcagaaaatatgtataagatctataagaggaaaactacaaaactgataaacaaaatctaaataaatggagggatattccattttcaaggataggaagactcaatattgttaagatgtcagttcttcccaacttggtctataaattcaaagcaatccaaatcaaaatcccagcaagctattttataaattacctgattctaaagtttatccatttaagttttaaacctagaataatcaacagaatacagtaaagtaagcttgaacgacacataataggcaatttcaaaacttactataaaggcacaataatcaaggcaatgtcgtattagcaaaagaatagacatatattactagataaatggaacagaatactgagctcagaaatagacccaaacaaatataatcaactgctctttgacacagaagcaatggcaattcaatggaaaaagagagtattttcaacaaatgccatgggaatatttggatgtttatatgcaaaaataagaaaaataacttagacataggccttatacctttaacaaaaattaactccaaacagaccataaactaaaatataaaatgcaaaagtataaaatttctagaagaaaacataggagaaaatttaggtcaccttgagtttgacaacgaatttttagatacaacaccaaagcataatctacgaaaaaaaattggtaagttggattttatgaaaaagttcattccttacccaaatgaccacccatgtactgggctcagccaagttcatcagctcaggtgtcaatattgtttaagagaacttgttgcatttgggagattaagaaggaagagatccaggatccctggcaatgtagtatccaagaaataggtgatcccagcaagaatctatgtatacaatttggtgtgagtaatctttcacttggccacaaaaaattttacccacttaatcatctgaataaatttctatctctcatcctctttctcattaagtatgcattactatctatttcactagggtattttgtgacttaatagtgtgcactgatttgagccttaacaggggaaagagctaaacaaaattctttatgtatgtatttgtactatggagaatacagaatcatgataaatatgcaataacagtataaaacaaaaagagctttaggacagacagatgaaggaggtgatgtggagaacagagacacagacattgtataaaccacggctaaagagataactagggcagatatccaggcaagaaaaaccagttagatcagttgtaaatcaaatatatttaactattaatgtcttggtggggtgaggggaaaatgaccttatattttgattagacatggatacatatgaatgttcaaaccaagacttgtagcaggtattgctagatattatccattgcctcttcagataacactttctaccttgtgtccaatctgccccagcagtctggcctttatggtctacattaagggatcccttcactctggcgtcccaggaaggccaagtggcaggagagcagaaggcaggaagagagtgaagcaagagtatttatcttttgaactccctcccttctgtgctgtggtggatgatggctgggttccttccccaagttcctagcagatagcctctcccagctgccttctgctcttgcaccacccctcattagcttttcttgaccttgcccacatctttgaaactgttccttagtttatttctcttcatctgttacctacctaaactcttactgataaaagcataaaacgtgtacaaagagaatatgaaatgtattaatttgctgatgagagcttttcagttgtaatgcaagagatcttatgggaaaaatagtgtaaataggatgcacctgctctgtggagcctactctgaaccccagaagttggttatgccttctttgttctccttgccctttacacatagcacatcattattgtgggactgtggtggacatgaaagaacttagtcaaagggacctcatgtgggaagtgtttcatgaggtgagggatctgagaaataaaggaatccctaaagttctggcagttggagttatatgaactcagtcacctgaggttggcttccacagttgtgaacaaccaagagacagcaagtgctgcacaattcagtgaggcccctcttaccttcaatgcatccatctcctcagacagtgagagcaagatacacatctgtagatctcctactctagttgagaatacacaataagaacatagtgtttattaatgagcccagaactgccttcttcctagtggtattccctgacaaagacaagtacaagctgtttaaaagaacatcgtttaatatcaaaacatctaggttatgataaccccaacactacacaccctgagacattatatgtatatgtatatgctttttatccccagtgccaaaacaaaactattttgagagaggatttacttttttaaagaattctcatgtcaaagcaagcaggagtggttttttaacatctaaattgaaataagaactgcatgtctgtctgcatagtttaagtgagtctccaatccctgaagtcagaacattaaattcagggtttttcatacaaatagcaaacaggagttcacccagataatctccgaagctaccagctaagaggccataactggcactaactcctttgtcacatacgcgcatttggtgttctcagctctcctcttaatcactaactcctggctctttctctgcatgatttttgggcatgtccctccatcacggcctctgctgtgtcaggtctaccattatagaccttggagcccatggttcctgttctcacttccttgactcctttcatctttccacccaagaataatttttctccaatacaatatctttatatcatcttcctgttcaccaggttcaaatgactgaatgtactcagacctgttttctcatctgtaaaaatgatactacaatggggctgaaagaatcaaaggtctcttttatctctgatctcattattcctccaccgaactcatttgatctcatgtaacaatcttttttgtggttggccccttgctgtcagccactcttcacacattcatctaacaaaatttactgagtgcctgcaatggaagaacacaagtgctaggttctagaaataaaattaaaaattcctttctttgacatgcaatagcagttatcatttctgagcacttctacatggagtatttcaggagggctcattgtatcctcacaataaacttatgacagaagcattattgataactccactttatagatgagaaaactgaaacacaggttaatacatggcccaagtcatataactagtaagtgactgagccaaatgtcattggttctaaatgattatgcctctgaaataattacagtgaaaagttcttaaagacattaataaaatactgaacaggaagatcttagctttgctgcagtttctaggatgaagggctacttgagctccaagaagctttccacccctaccccatgccgatgccatgccccatctggagcactcatcacatagtctcagccaagtcatttccatctcaagcattgtgcaaaagacaaacactcaccttgaaaaaaaccatcttcaatgaatggactgccatctgtgctttattattttgtacataagattgttactttgtacatatactacatttgacataattttttttaacttgttctcatgccatgcttaatctccccaaccaatctatcaagaacacctccagccaagcctggtatagtgcttatcaaatagcaagcaaagcttgttaataaatcaagcaattcactttgtccagggagtcaaatccaaaccctccagacaagtttgatgacattcactaaccttgacctggcagagcctcccccatcaatccaccagggctgagttgacaacaattctcctccaatcagttctccacactcctatccctgtgacttttatcttgtattaaacgatcacataaacactgagcctccaaagcagtgaaaggaacttttattttctcatggtttccatctcccagcttcttctattgtatcgtaaatccaaaactgccataaaagttagaagcttcagaagtgtcttttataggaatttggattgtagtcaaacatctaccctcagtgttctctttccagtgtggcatttcctccctaccacctaatacaagtatacacagtatggtaggaagacctgcagacctaagcaggtttgagctatttttccatcactcatcattacaaatgtgtttgtgttttcactgtggggtattcttaaaccctgctgctggtgatgctttctgtaaacagtaattctcaagtgccttattgtgaatacaatgagtcatctccagtgcagagaagtggctttatttaggactggccagagggggatgggcatcattatattcagtttgatagaggatctgcagaattctctcattgccctgtacagcaggtccagtttctttttcgttctcctgatagaaggactgtacgcctaaatattcagcacatatccccaaattgatgttttacctaaattgtttcttaattggctcaaattaagtgcattttgcaaatcctccctcagtctagtctgtggcctaatgactgtctgacataggaagcactaaatgtttagttaatatttgctgaacaattaaaaaaaggaaaaaatagaaacaaaggaaaggaggtaaaactgataactgtgggtgaaaagaagtcaaggtcaaagcctgcatctctgtctggttcatgaacaactgagccttacagggttaaaactattctgtgacccccaggagccaatcagtcccctcaaatttatactgttaggagaaccttttgaaagaaagcaaccagcttacagcaactcatccccactgctggaaaaatacaagtcaacatattttgacctctgatggtagagccgcaaaactaatgtatcagatatctacttccataatagtactgcataacaaagagccacaaaaacctcagtagcattcagcaataagcatgtattgtttatgcctgggccagctgagggctggctagatggctctgctaatcttggccagacttgttcacgtctgcagtcagctggcagttagctgatatcagctggccttggctggggaaacagggattcctctgccctgttccacgtatctctcatcctctagagcaggctatgcagacatgttgtcatggtgatggaagagaagcttgccactagaaatacacaagggctcttgaggtctaagctcagagctggtataccctcatctctacctcattctagtagccaaagcaagccacacagcagagcccaggaacagagaattgttaatatgtcctgcctttggagttcgagaccagcctgaccaacatggtgaaaccccatctctactaaaaatacaaaagttagccaggtgtggtggcacacacctgtagtcccagctactcaggatgctgagacaggagaattgcttgaaccctggaggcagaggttgcagtgagccgggatcgtgccattgcactccagcctgggcgacagagcgagactcggtcttaaaaaaaaaaaaaaatgtcctgccctcagtggaaatgaactgtaaagttaaatggcaaaggaagtggtacagggagagatggagaattaagaccagtgatgcagtctaccccaggtatatttacataaaaataaaaagcagagtattatgaatttatgaattgcaaagatggaacccatgcatatttatagattctgaagtaaccaaactaaaagacagtgcttattttttctaataaatatctagctcagacattatttttttaactcattcttattgtcattataattagttaaatattagcttgaggtaaaaaaaatcatgctgtgaatgaattgatttctttcttctatgggtattctttagtcaaatggtctggtaaaacacttttatgagctactaaaagctttgaacgtttatgtaagtctatgacaacagtacatttttccaatttttacagaggagaattaaaatatcctatctgatataacaaggattatgaatagattaaaaaattatttcagtattttaaatttaatactctcatttaacaggtttgacaaaatgaaaagtattagattctgattcctagatttgtatttctcatctgattcaattatgtaagcttatattttagaaatgccaactcctttacatcagggccaagactaaataactctgcaatatcagaagaagcgtcacattgaaagaatgctgaaatgaaattacatttcatctctacaaaagtcagagtctctatttctgggttcaatgcatttgacagtttaactacctacattgtttttatcatataaaaaaggagagtgttttaatttcaatcccttaaccttctagcaatgaaatagttccagagaatataatgaatataaaaggggtcagtgttcaaattatattcatttatagctaattggaaagtttcttttgttgctgaagaccaggacctttttcctgtctatctgctagtgactatcactctgatgccttaatcttcaagtggacattctcttcattcagtgcaattatagtaacctgaaaggtaatgtagtctcataagagatatgccatcatcacacagatttatgggcagaaccacatccataaaatttagaaaattgcttgtgtactaccagcctattttgcctgttaatataaataatattttcaacattagctaccaagaggacaaatttctcataactgactttctgcttaattctgtcagataatctctgctgtaatatgatgaagaatatactgtgaagaatttctgacaagcttcgtttttctagggtgttttgctgaagaggcccaatctgttgtttatttggggctggtaccgcattaaattgatttagggacaccattttccatttttctatcttccatgctctgttaacttatgtcatatttattacaactcttggttttgcatgtatgtttcaatttgtggtagcaaactgatgaaacacgtttctccccttttttgtaaaatggtgtttaacaactgctactcctattaatgtattgccaccttataagtaaactcaacatgaagagatctacacaatattctgattaagaaattctacctggggcacagaatatatgtgaaataccttttcaaataaaaacttggaggaagtaaacagagcaaatgcataaaagaagaacatatgttttatgctaccaaattatgcatcattattttgaatagctaaccaaagtttgttacagatactaaagcttcgtttaaattttagtccatttgcagtttgtcattgttgtttaaaattcctcaggcaggggtgtgagtggaggaagttacttctctagggagatgaactctaaaatcttgtttctgggagatactgcaatttgtggtctcagattctagactattccaaagaaagctctctgagctcctgtgtgttaatttatgacatatctgctctcacccgataggtttgtgctttatcacgagtctcagggagcccatcagggctcacaaaggaaagaagtctgagacacataaaaaatatatgactccaagccagggagcactttacgttgtacacagcaaaggaacccctggtaccactgaacatgaaggtcatgttctacgcaagtacaaggactgggctgccatccttacattcttcatgttattaaaacaaaatgtctaatcatgcctgaagctgcccaaagccttgttggcgaagagatatcaagctggaacacagcaagtccacaccttctgctttcacccactcccactttctgtatgcacactctgaccctgctctggccagactgacctatttatccccttcccctaaaggtatctcatgtttcccaccttcaagcctctccacacctatattttactcatcttttaaggtccaatttcttagagtactccaaatccaaagtcagtgcgatctccagagagaaacaatacttttaatttctctactgtccatatagctaccataagacttatgtaagtattcactgtttccctaatagattacacattttctaaggataaaaccatatttgaatgtccagttatgctcctaagtggctaacattgagccttactcaaagtaaatgcataacacaaatttgtttttatgcttttaatacatgttggtatttttaatatttttcttctcgacaaaagaacacaacatcatcatacatacaaccttcaaacataaatgagaatgtaaaagccataacctccatcaatgtccaatcaaagtgctggtcaatggaagagagagtttacaccattgacccaagcatatgtttcaggctgtggtgaagcttgaaattttcatatcatttatttgctggatgacccaattaggtcaaaacctacttttctttattggaatgaatcccctagcaggtaggtcaactccgcaggacaaagcttctaagcaaatgtgaggtcggttaattctcatatcaactctaatttgcagcaagactcccatggcatttcaagaggctttgagtctttctgaggcttaaagagtgaggtagtagcttcttttgagcaattggtaatactttgggtcaagaacggtagctatggaacatatcctaataatcaccttctcaaatgttacagagtcttgcaagtgacagaaaaagatggaaaaaaatactctcacagtttaggaaactgctttcataagctttggcatctctaaaacttagattccagcccatccaaagagctctttctgcagtatctgttttcaggaaacattttcatcattgatccaagcatcagaaaacaaaaacaaacataaaaatacaacataagatcccaaaagcatcagcattcaatcactgtcattacatgaattatacttgaagcatgagcaagacacatgaggccctatctcaaagatgagccacccctactggtgatagagggcacccagagagaagcaagaccctcatttaccaccagctgacccacaggctctgagctcctccaatgactgagtccaaagatgtagcttcccctcactctttcaaaactagtcctatgttttcaataactagcttttctctgcctcagcatcctcgagtatacaacaaaacagtagaggatgatagaaaaatgtgggctttagagttggagtccaacaaaccaaggttatgatcttggataacttcatcaatctctcttagctttagtttcttcatctgtaaaataagaacaatgtttgcaggactgcggcgtaaataagctaatacacaggtgagagtaaatgttagctattatcattatgagtactgttattatcagggtgtcagattaggttatcttctaaatatccattctacttccaaggcttataaaatagagtttgaataaagcccccattcaacctttaataaccctaaagattaatttgctccttctgcataataatgaaaggacaaggtaccttgcggatcctagggcatatctgttcaagcaccaaatactttttaaaattaagaaaataaataatacttggaaaatggccccattccaacaaaacccttaatgtttaatccgtaagaagtcatctgaactctcatttaactagctttcctgatggactgattgtatgggggacatggaaaatgtgaataccaagtaatgagactgattttggcaagacatcagagaaatcagcctaaattactccttagtcacacttacataggaaaatcattttaagagactttatatcaaaaggattaataaataccagtcaagtcatgttttccagggacttccaggtcacatggtgatttacaaacaggtgtctaaatcccccttcccccaccccagattccaggtgaaatatcaagtagaatattaaaacgtgaaaataaagtttcatgttgacttctctagttttgtcgggctatttatagggatcaaatagtgatcttattatagatcactcccacagcaacttggtccttgcccatttctctttgccatccttcccacaatgggtgcttcaactttcattccactcattgtatctgatacatatgtacaaattctgtcagttaaaaataaatttttaaaaattttaaatgtactatctattctttaaaattagtttatcctctattactattttaatgtagatatagagagaaaaacatacctacacatgcttacaccatttaattttatatgtagttttctttatggaacatgggatcagtcattcaaaacaaataattttgtcatcttcaaaaattccagagtctagatattgttatgactacctggacgggggaaaatcttaactaatcattaagttaaaaattagctaataattattagagctcagaatgaacaaaactagttaagccgcataccttacagaattctaccttgtcaagtcaggccttttagattcagcaaccctaattatccatttcagacctgttgaattacttaaagtactcaatgtggccagttctatcccctccggacctatgcactttcacctccctctcctgtcaacttagaagggccttccccaccattttcccaggaacacttcctactcttccttccagacttaactcaggtgattcctctgggcctcctttatgagcctatccagaaaaatgaggtgctcttccctctgctcccaccaaaccctgagcatctctcttcacagcattcctgccactgttttggggctacttgtgtacttgcctatccacccccttccgcaaaatgcctggtttttatctttaaaggtaggtatttgtttttccttatacatctttgtcttccccgacacccaaatacagcctggtgtaaactaccagcatttaataaatattgaataaataaatgaatggatggaaaataaacaaaaagcttaagtctctctctacattattataacctcttagtgaaggatatatgaaatgacatcacctacaagtattaatggcaaaataaaaacatagataatgagcactttaatgtgctttcattaatttatttatgaagaaataatgtgacattcaagtttggggggattcctataccctaatatctaccattattaaataatagttttcagtctctgtctacatagtcattatataacaagaacacatgcccagctgggcacagtggctcatgcctataatcccagtacttggggaggttgaggcagggcagattacttgaggtcaggagttcaagaccagtctggccaacatggtgaaacttcatctctactaaaaatataaaaattagccaggtgtggtttgcatgcctgtagtcccagctacttggaggctaaggtgggagaatcacttgaacccaggaggcagaggttgcagtgagccaagatcacaccactgcactccagcctgggcaacagagcaagactccatctcaaaaacaaacaaacaaacaaaaaaaaaaacaagcaaaaaaccacacatgcccctaccagccaagtatcctttagataacatattattctgcacatgcttccacattgttacacttccctcataattatctctagtcttgccaaataacctgttaatttattcataatttaaaggcaataaagcagagccttgagcaaggctgcctgagtttaaatctggactctctcactttgcaagtgtttgatcttggataagtcacttaacttctctgtgcctcagtttcctcatcctgtaacatagagatgataataagagtgctatcatatggttttggtgaagactaaatgagctaatacatttaaagtgatgataagaggtggttttgttttgagactgggtctcactatgttgcccaggctggtctcaaacctgttggtctcaaacttcgggctcaagcaatcatcccatctcagcctctcaagcagctgggattacagggaggccatcttgaagagttcttgatacatggtacaaacgctctaactattagctatatatttttattgtaattctgaattcactaatattggtctaggttgtttctatattatttgcatcacactagcacatttaagcatatggatttgaggatggtttcttgggtagttggttttgtttcaaattctcaagatttctaactaatttccaaaagggcttctaatctactttttaaatgctcatgtaaaaattacttaattttatatgtgtaaactactttttaagaagatacttcacaaaatctcgacaacctacacagatagacaattgtcaaagaagttggaaggggccaacattttagtttgtacttgaagcttttcatctcagaggagttgctaagttactatctctatgcacatcctagcaagagggagagggttgtgaccaaagaaacaatacttttttcctactgtgcttcacaactcaaaattcattgattcgtatgtatattttgttttgttttgttgtgactaaacaatcctagtttctttcatctctttcaatgaaaggaaacatgtctgtcaaaaaaaaaaagggggaacagcaaagggaaaacatccctcagagaaaggagtgaacaatataaaggtaaacaaaccagggatttctttgatattgcccatttgtttgtgagaacaaagtaacaaacactgaaggagaaccaagtatagattaggcataaggtaaaagggagaacattattcttcattgttcttatctcagaggcatctactactaaatgatgtggggcacagaaagtgggcaaaggaaacactcatactctataaacttacctcctctgggtgataatacatgtacacccagtgccgtttctttagcaaaacgtatttgaaatgcaaaccccaaatcatgttcatactctatgtcttttgctttctagatgtggaatcaaaaaaaaaaggaccttttggtttatctaggcctaatgaggttgtctttgattcttgattatcaaatagttcatttgtttaaccaatattcatacttttgtatttttgatataattgtacaaatttggggaatacatgtgatattttgatacatgtatataatgtataatgatcaaatcatggtaattgggatatccatcacctcatttatctgtgttgggaacattataaattttctcttttagctatttttaaattacattattgtaaactaatttccttactgtgctattgaatactaggcacagatcacaataagatgcacataaactggacaaaagtctttgtcaccacgaacacagatatgtactgaatttgattcccaaatctgctctgtggccttagtcaagttactgaactcacctgagcgagtttcctatgaaatgaaaatgacagtaattgtggtgcatctccttgtacagctgctgggaaggccaaatgggctaattcttataaagcaccctgtgcatagtaagccctcaataaatgctagctactgttgctattgttcctttcattgagagatgttttgtggtgggtttttgttgttttgtttgtccattagccaagtcagaatatgacctctggcttgtattgtccagtgctatttttcatagaaatgaattttttttttttttaaagagacagggttttgctctgtcacccaggatagagtctggagtgcagtgatatgatcatagctcactgtaacctcaaactccagggctcagtgaccctcctgcctcagcttcccaagtagctgagattacaggcaagcaccaccgtgcctaattttttttttttttttttttgagacagagttttgcccttgttgcccaggctggagtgcaatggcgcaatctcggctcactgcaaccttcgcctcccaagttcaagcaattctcctgcctcagccttcctgagtagctgggattacatgcatatgccaccatgcctggctaattttgtatttttagtagagatggggtttctccatattggtcaggctggtcttgaactactgacctcaggtgatccatctgcctcagcctcccaaagtgctgggattacaggcgtgagccaccgcacccggcttttttttttctttaagagagaggggtctcactatgttgcccccaggctgacctcaagtgatcctcctgcctcagcctcccaaagtgcaggtgttacaggcatgggccactggcacctttcctagaatggattttcaactctgtttaaagacgattgctaatgcacagccaattgaatgcttattaagtagaaattaaacttgctttcaaataatgagaacatatgtcacagatgaagagttggtcctagtgcaagtttacaaataaaagacaaagaacctttcagctattgtgactagttagtcccttcttttacagatgtgcccatctgtgtgacaaaagaagcaaggccttttcaaatctttgcagagatggcacatgataaaagtcaggttccactggcttggatgctgattgccccttcaggattacaaccaccccagttccctgcattgtttgtgctatatcatgagagaacaggggcacatgaggacaagatttcttttcatttcacctttcagcagccttgtctgaaaccacactgactgttgttaaaaatgatgcaaattgtgcctcctttcagaaaagcacaaaccattctcccgttttcccccagtccaagaactgtacaggaccttcattagctagaggaacacgatgatggcagtgcctattttaagcagaaagatgctctaaagggaaaaacctaaaaggcttcagacaaaatactattcagtttattatactattgatttttagaatactcttcagctttgctttttttgcggatatatgtcaaataaccagcagtgctttaagttacttgtagaagtatttatcatatatattttttcttagagaagagaaataaagctttggtatggactaacccaaaattgtttgggaggtaaaacaaaactttcagatcagttatgtggcaataatcaagacacccaacatgattttaattttaaaagggagaattccattataaaaatctaccaagtttcctcaggctcatccccacacataccttttctggtctatgtaagttcacctgtttagcaaagggatgggattgactaattggacactcaaagctttcccccagctctgagttcatcccagcttctttagattttttttaagaacaaagaaaaaccaatattttgggaactcttacatgtagataatgtcagaattaatttccacttgtggcaggatttcagtaaagttataagacctcatatactttttgtctaagttaaagcaacatctttacatcactttaaattatacaaacttctaaccaataaaaacaggagaagtatggtgtgtatttgtttccatgggcttccataatgaaggaccttcttgggtggcctaaagcaacagcaatttgttatctcacagtcctggaggctggaagtctgccatcaaggcatcagcaggcccatgttctctgcaggctctagagaggacccttccttgcctcctccagtgtctggtggtcactggcaatccttgcctcctggatgtatcactccaatctctgcttccatcttcacatggctttcgcccctgtgtgtgtgttttctcttcttataaagacatgagtcattggattagggcccatcttaatgtggtatgatctcaccttaacttatttaattaaatatgtaaagaccctatttcaaaataaagtcacattctcagattccaggtggacacaaattttggggaacattatttaaccctgtacatatggagtgcaaaactactcacctttcctttaccaaggaatttctaagggagtcaaattaatttaaaatcttcaccaacttctcaacaagtgcacagctttattatatccaagatcataaaatctgtcatttttcttgcttatgttgatattgtgctttatatttacaaagttttttcatattgcttcatttgatactcacaagcacaaatactcattctcacacaagtaggcagggtgactggtctctttttacagataaagtgagggagaagggaaggaagcttaccttttatcaaataactactctgtgctagatactgttactagtgcttcatgagttgtcttatttgatctatataaaaaactcaaaggttactgtaagtagtattattcccattctgaagtagagtatagcataaaatagcactaaataacttacccaaggtcacacacagctagtaagtaacagatctggggctgccgctcaaatgcacctgtgttctaagtccatcatgtttccattcttccttctcaattaagccttcttcctaacaagtctttaactttgttcatggttagaatttgctaaaatatgtttggtggttgaaagtcatgacaaactcagtgatctcattaaaggatcaaccggagagatctaggccacttaacatgacacatacaggggactatgctttttgtagttatccttcatgttgcaataaaatgcaaaattttcctaactttgaaaatagaggaagaattgtggtggtaagaatcgtcaaaaatttacccacttttggaatagcctcaactagagtaaccctctaggactttcatttattcttctctgtgagtaccaatagggtgaagtcaaaaaatgactccaccattctgtggatggcccaaatcatgagaatgaaggaaaagaagttatcataaccttaagaaagaataagtgggaaaaaccattgttccaaatgtgggcttgaatatgctgtaatgtttcaaagcagcaagtaaagtatacttgttaaggatactctacccacctatgaaccattggagaaaatgaactattttgatgctgcctttaaagagttgtatcttcagagaagccaaaattcactgctgaaagattccttcttgaatctgtctcagaaacaatcttggatttagaatgtacatgtatatacttgtgtatgtgattatacttaacaccatcagttctaccttatattataaatataccatgataacagaactttcttttcagattgtgtcaaaaaagaaaaaaaaaaagggtctcactctgtcacccaggctgcagtatagtgatgccatctctgctcactatgatctgcctctcaggctcaagcaattctcatgcctcaacctcccaagtagctgggattacctgcgtgtgccaccacacctggctaatttctgtatttttagtagaaacagggttttgccatgttggccagggtggtctcgaactcctggactcaagtgatctgcctgcctcggcctcccaaaatgctgggattacaggcatgagccacctcacccagactcttttcagattcttaatgcattctacgtatttacaaataaatattgctaatagctaccatctattgaatacctactgggtgccaggcagctaagcacttactgtacatattcctagttgtcacaataatcctacatggtactttttactgatcctcattttactggtaaaggctctgagactgagaagtttaatgtcattcaaaacctactagatgggtgagccagaatttggactcaagttcacataattccaaagcctgccaccacacaaggaaaatatccatttattcacttatataagattgttgacctctttaaatatgccggtttcatcctaatcctctaaaaaaattagtcattctcatcttttgaagtccctctgacctaagggtgattcacagaggatcaagtaggtaggatcaagaatcctcatcttccgaatacattcatctttttagcttgataaagccagaatgttggggcctaactacgtagacaatttcctcacatttaattagaagacagacctaagacttgtctttgaggccaaatgctacataccaagttttcaccatgaattatgtttcatgagaacatggttgaatccatattaatactggatatctaatagagatcatgttataaatgaaacaaccatttatggataggtaaatattatcaagtacatgtttacattttcatattacatagcaaatcgttaggaaaccaagtgattaaatttggggttttgatggggtacacatggatgtaaaaatggaaacagagactgggggttataaggggtgcaggcatagggctgaaaaactacctattggctgctatgctcactacctggataacagattcaatcacactcaaaactcagcatcacacaatatactcttgtaacaagcttgcacatacaccccctgaatctaaaagttgaggccaggcgtagtggctcaggcctgtaatcccagcaccttgggaggccaaggcgggtgaatcacctgaggtgaagagtttgagactcacctggccaacatggtgaaaccctgtctacactaaaaatacaaaaattagccagggatggtggtacgaccctgtaatcccagctacttgggaggctgagccaggagaatcgcttgaaccagggaagtggaggttgcagtgatccaagattgtgccactgtactccagtctgggcgacacagcaagactccatctcaaaataaaataaaataaaataaaataaattgaaaaaaataagaaccaactgttgaaacctcaaaaaaaaggggggtgaggcggtgggggtgagttttgaaaggtttaactttgcatgcattggtttaccaaaggaagaaaaagggagtgggagagacagaagaaagagaaaaaaaaactccataactagaaaataaatgcctgcattgtagaacttcttaaatgttattttcataaagttatataaacgtatgtcatgcaaataaggacaggtcaaattgaaatgtttataaaatatgctaaatttaagagttgtagtcaaaatgtattatagaatctaactgtggagtttattaatttacattttcatggcataaaaatagcaggactcaagccatgcagttaatgtacacaacattcactgaattgtagacacaaagaggctaaacactagaaagcagcttttaatattctgtaatgttctttatcaagctgtttgtacaagactttatgaaacacagcacacggcttaacaatctccagtgcattattatacatatctaacttttgccttcggatactcccagcaaaggacaacagattctcaactttactgtaccaaagcaatgtggtcaggaaagcagcttccccgttctgcagcagctaaatgtcagagagccaagggttccaccaagatttcccaaagcacagcagttgccattagaaacttcctaaccctccaatgttcactttacagagtgttcagagggtgataaacagatcttttacttgatttgccatctgtgaattttaaagctgttaaggcacttttctgtctttatttccatgatgctcctgatcccatttgctagttagatgcactcactaatatattattcagttctattgagaaaaccatactgaggcatctccgatttgacattactgtccaaatttttttttttttataacatatcaagtaaaataaaccagcttgaaaccctggccttttttagtgcttcaaataattcttttcatttctttgttactgagagctcacattagaaagctattaatacatttgagtacaatttatgttttcaatgcaacccagacaagaaatgaaaaggcatggagaagaaacatggccttcctggacagcctgaatcagtaagtcgttactcttcaccaaatgtagcttatgtacaaatggcttcatttccattccccttcgctgtgggagcctcaagaaccacagttacaggagctagaggatgacgctgacagcggtcacacaggcagtacccactcgtttcaatagccttcgccttttccatttgttggtttgcggaaagacaaaactgtgctgatcctgattgtatgagacaagaaaatccagccaattctattttacgtggtactcttgccttagtttctttttcagtgagaacagacgcgccactgctacagctggccctgtatgttatttttttccagcattagtaatggagtcattgattcaatctatatgaatggagtccctactaagtgccaagcatataacagtgaacaaaacaacctctggcctcatagaactttcattcaaggcggtgagatgggaggagccaccaacatacgaaaacaaatgtagtcacatttacattaatgcctgaattaccaagactcgggctttctttgaagccttccccagccaatttgagggcactatcagatgtcctgtaatatgcacaaaaccaaccactcattttcctccactttggccttcttgctagttgtctccttgtggggcaggtaagagacctgacacactgccacatctacagggctaccaccaggtcactgacataagagtcagcatctccaccactgttcgccactctctaccgctctgcagaggccactggaagggtccagggtaagaaacctcacctggggtctatggcagggtagagagagaaagctggaggctcccccacctgctaatattacagttggttacctcggccctatggttctgtttgtgcccaaactttcacatggtctttcacaaacacgactttttccccttctgaccttcacctttctcttcacccaggctccatgtattcccttgtattctcatctctttccctcatctctctccaggcacctatccacaaaataggttcctcttttttcaccagaagcagaaatgtatatgaccattatctcttacaaccacatccccatagggatgactaacctgatgctcaaagagccacagtccaccttggactccgttaggaagccctgccaggtatagatgggagaactgagctaccagcatcaaggacaccagcaccagaaccagtctttgaactattcaattttatttcctaatgaatgtatttctccacccaaatgctgtgcatcccaggctcttcctcaacctctacctacagagaggatgatcagctcttgtgggtgaggtacagtcacaccagtccagcaatgtgctttgcgattccttgccaggctggattccctaaccattctggtaagcctatcaataagcttgcccaaatgcggtgaagacctctctcagaacagccggagtatattaatccatttaacctgggttttcctaatcaatatggaaatgtttagcctctgaattctgaaggattgattccatactcctgtatggcattccctggctatcaactgccctgagtaggttagcctcaagatatgtgtgggctttgctaaataaactttgataaaataagtaacatttttctgatatatatgaaaatggttttctcatctgtgttggacttttccacagctacatctcctgttctcatgagaagttttacttcctcagaattagtgtgcctccgtaacacaaaacttcagaaaactcccaggcacatgcatgtcaaatgcatgtccaataggcttccacagcaatcttctcatctgtaattcacccagggaagaagcaagcacctccagtgttctgcagactcacagtaatccaagctgcttaaatccttcataaatcctctgtgcaaaaacactaaagagattgtcagcaggaaattcaaccactggttacctcggacattcctagaagacttttccttaattatcagccagagcactatgtcattaatgcagacaagagttgacagcagctggtctaaggcagtaatagcagagacagacacacaaggcaggttcagaagctaaccaggagatgaaatgggacatggcttgtgtgaccacaaacatgaatgcgtgtgaggaatgaaggaaaaataagacccagcaatgattccccaggtttctggcttagatatttgagaggatgcagccactttttattaaacacaggaggaagagcagacttggggagatatatggttaactgcacactaatttatatttgcaaaatgatgaagcacatggagagcaattttttatttttattaaattgctgattatgttcttaagagaaaatatttgtatttactatctatgcatttgaaccatcagaacccttattttcaggacccttattcccaagttttctatgtgtctcggtaattcatcaaataatattaaccagcaagggagggaagtaattaagtgaagatgaaatttttattaaaacactaatcataaatgctcatttacttattcgacaaatgcttactgaatgttggcaatgagccaagtaccaatgtgaacgacagaaacatagataacaatgatactgaacacataaggagtaccagccaccacaataagcacgtcatctgccattgacaatccccatcataatcctgctaggaaggtgttattacaatgactattccatagatgatgagaactaaaactaaaatcctaaacccccaactggctgaacaaatcccctcttggttaaggggaccccagagaaaccttagaaactgagttcctggccacggtgcgatgggaagccagacccgtctcattacatcccctcctttttgtggtttagacgcaacaactgaccagcatcaatgttaacatagagatcctaagactaacaaaatggactctgtggcaataagataccaaattataaagattgcctaaggccatgccaggcaagggttaagtcatgcaccctccacacttaaagagtaaattctgttccaactgccacaagtttttctttttctctagcagttaaaccagcaccggcctcaagataagcactattgaaacaactgcagcactctcaccaccagatgctgacccccggccgattccacaagccatacccacattttttgattggaaaagagacagctgtggttcagtaactttctcctaataagagaccatggaccatggactgatctggctggtttacagaggctgtaaacttgagggccttcgtgtccctgccttacgttttgccatataaggcctaattgtaagacacttaaatgttaagtctccaccccaaagtgaacatgggatgcaggtaatacgcatgtttgcttatcacacgtgtacctctcccacttcatgattattcatagctcctcctgtaacctattgaatatgtatacttggccaacctcagcataaatccctgttccaccccttcctccctcaaagtgtctgttaatagcctctgcaagaggctacacttcccagccttcaaaaatggccagaccacaggctataaccctttataagaaataaagtctccttcacagatttaaagatcttgtgatttttccatgatgaaactgacatagcaacgtgttgagtaacttggctaatgagtaggaaaccaaagtttataccaaaccctgggactctagagccggtctctgccatgcctcttccctcaaggaagtcaggatcctcttgggaggcagaccatacatgtcattagaaagcttttacaatgatcaccttgcttgttcatctcaactctcgcagatctgccactttcttcagtcctctaaccacttgattcggtacacttgatgtgatctagcattaccagtctctcctccaccacatgctgcctgtaattgtagcagtcacttgttttcagtcatatcattacagagcagcattgagttttccagtttataagcagcccaaatttgttttcctgttgagcttttgccttgaatgtctggcttttccttggggatacatagttcccagttccatttcccacaggagctttactctggaatgtctaatagtgtgtgtttgtttcaacatcggggatataaataggtaaaatgaagttctgcttggtgctgctgcacggctgcaagaaccaagggccagccaatcatgagctgagggacttactgtgtttgtttaaatatagttcaggtttctcccttctctctacctcaacaagatttagcacctagaacaagacactacacctttagtttgcactccgaaattgctaggaagtaaatccatctggaaactgcactggataaggagcagggatacacagcagtggctggaaagaaattactcaagtacgaaatcaggaaggaacctcattaacaccccaccaccttttgtaaagtcaataatacactgtccagtatgaaacccagccaagatctcagctgttgactgttcagtgaaagaggaacatgaaagtgacagaaggacattcattccagaaaccctgagaatccagcagcccctacctggtctccagctccatgacttgccaccgccctcactgctccagtctaaattccacaccttcagagctagagtcagagtttccagggtggcaggagtggagtgaaccagggggatcccagcatcctcctcaaatgtagggactaagactggcggggaaaaggggcagggtcctttggggattgtaatgcacccaaggggaaatcccagagatccaggttcagtcctctggccctccccagctagcctgatgtagctccatcttcactgaagttcctctggtgataacacatcatgttgaagaggatatttagggcttcctgagacaaagctgtgctaaacacatgaactctcagcaaatactagcaagtgaattaaaaatgaatgaatatcctataaaacaaagcaacaaatcagacaacccctacccccgaccccatggctcaatgagagcttctggacctgcagcatccccacaacatataattcacccactaccccatactagagaaacctaggaggctctcgtgtcctggggagcaagctgttaagtagaagtgggagaattcctaaccctgttaagagttggaatgttaaactctaaagataagcctgaaaaccagctttaaaaaatgtgagcattcctagttaacctagataggcagaattcttttccctcctatcaagacaaacccacagtagctcaatgcctggattatgaggccacatcacaaagatgttagttttttcagtttgggttgttgctgaaaagaaagtaagaatttaggcattacaattcagactagatccattcattaggtccacaccacaccagtaaacagtgatacagatttgcatagtgtttttttaaattaacatttaataatgttttacttcccaagccccttatgagctgggcattggctaaaaaggttttggctcagtacaaagaagaatgttccacgcctgtgaaacaccaaacaatggagcagtggtgttgtaagggagtagcctctggcccattcaagtcaaaactggataattatttgttgcagatgctttaaagagttctaataatttaggtgttaggtgagaataaataatctctaagatgtcttccaatcctagcatacatgataaattttttctgtggaaaaagcacccaaacagaaagtgaccagtgactttccctagtcacacaaccagaccctccagcttctagcctaacactctttccactggatggtcttcaccaccaccagtactcagccccaagacaccaggggaacactggcactgtccctttggtttcatagaaaataagcacaaataaaagattcaacatctgaccgacatgctttcccatattttataagaagatcaatttagtaccatataggtaccaaggtactataggtaccacataggtaccaagttactataggtaccacataggtacattagacagactgttttgtaaacttctgaaagccaatacaaagaacatctcagagttagtatggtagaaccttctagaacacttgtcatggcctgaatcttcatgtccctccagaatgcatatattggaacttgtattagggttctctggagggacaggactaataggatagatgtatatatgaagggaggtttattaaggagtattgactcattcaaccacaaggcgaggtcctacaacaggccatttgcaagttgaggagcaaggaagcgagtctgagtcccaaaacctcaaaagtagggaagctgacagtgcagccttcagtatgtggtcaaaagcctgagagcccctggcaaaccactagggtaagtccaagagtccaaaagctgaagaagttggagtctgatgtttgagggcaggaagcatccagcatgggagaaagatgaaggcgggaacactcagccagtctagtcattccgcattcttctgcctgctttattctagctgtgctggcagctgattagattatgcccacacagatggagggtgggtctgcctctcccagtccactgactcaaatgttaatctcctttggcaacaccctcacagatacaccaaggaacaatactttacatccttcaatcaagttgacactcagtattaaccatcacagaacttaacccccagggtgatgttattaagaggtgaggactctgggaggccccaccttcatggctgggattactgcccttttaaatgggttgagggaacaagtttacccccgctttggctccttccaccctgtgaagatgcagcaaccagacaccatctgtggagcagagggcaagtctttaccacacaccaaatctgttggcaccttgatcctggacttaccaatctcaaaaactgagaaataattttctatcatttacaaattactcggtctaaggtgttttgttatagcaacgggaacagactaacacaaccctatacttcagtatttgggataattggattaaactaataatttcactattaccccataatcaaacataatggcagcatttatttggctgagtttcatgcttagagtatgggaataagaattgttccattataaaggtcacaaccttacataatgatctcccttacataatagtcacacccctatttttggaccggcagagccagcataaaaagtgttatcattacacaaatacagcactttagaggtgtttttaaggacagaaatatattttcaattctattactatttttcaaacagctgaggctagacagagattccaagtgccctgcttcgctgtttttgagctgtcaaagaaaatgaatcaactgactacagtcacgtatctaagacagacatagaatttcgcaggaagtctgaggttatttgggtcaagttcatacggtatttgatctacagcctgataatacagcttttgtgctatatgagcacactaggacatggtgttatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgtccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacatggtgttattttttaactgagacataaaaaccaaagtaacaatctacttgtattcattgttaagttttcatatccttatagccaaagaaaggaaaaccacttccaaccagcctgcttctattaatacacacagtgatctttgacgtaaatgtcacacatgttcactttaggcttctggtcaaatttgcatgaggccaattaaattctgaggtcctgaatctcctctgtaaattcaacagatagatttctcttcttgtactaagctattgtttggtattgttctgaactactcaacagctgtaattctgcaactcactggatgttgaagggtataataattgtaccgagggatatgaatgtgtgtaaacccaaagcccagtgctgtctctacggtgatacacttatccacattcctcccactgtcatgacacagtcctcttacttcaactggctcacttctccgaatgcctggaacttcactcaatttaccttcccttatacaccttagatgtcaccttagatagtgcaccttaaatgtgcactattatggtagccactagccatatgtggcttctgagcacttgacatgtggctagcctaaactactgagatgtgctgtaagtacaaaattatatactagattttgaagacttagtatgacatatgtaaaatacctcaataattttcataccagcctgctgaaatattttgcatatatcaggttaaataaaaacatacatattatacactagaaaattttaaattatgtgtgtagctcacattattggataatattgagttggctaattttaggctctctttccctgactccattctactgagctctcttcaattacacataaattgggtcttctaattttatcctttatctcttaatctccttttctatccttttgtttttcctgtgctgcattctgggtaatatctcatatttatcttccaaatcactgattctttcttcactaggtctaatctgttgttaatccatccatccattacattaggttttatgtttactttgttttgatgttttgaatatggttttgtttactgaacttccagacaagatttcatctggtttagaaaaatattggaaaccattaggcaatttctactaatgctgaatacatgcatactctgtcaccagcaattctactcctaggaataaacccaacaggaaaaaacgatagcccaaaactgaaaattacccaaatgcccaacagctgtagaatgtggcatattcacacaatagaatactaaattaaataagaaaagtataactatatggaaaaatatgaagttcttttatcctttttcatatgttgagagacaaaggtcatatacaaaagattatatagtatataaatccatgaataaaatctttttaataggcaaaattaaaatggtataagaattcaggatacttgcataatagtcacacccctatttttggatactggttgaccttggagtaatactagttgaccttggagtaaaagattacatgaagggaacagaaagggggtttatgagatgctggtaatgttctgttccttgatctgaatactggttacatagtacattaatttatggaaattcatcatggtatatccttatgatttttaaactttgtatataatttaacagtataacaaactcaaactctaatcagtgattttcagaaaaatatttggatgttgtattagtctgttttcacactgctataaagaacgacctgagagagggtaatttataaagaaaagaggtttaattgactcacagttccaagtggctggggaggcctgaggaaacttacaatcatggcagaaggcgaaagagaagcaagtcacgtcttacatggcggcaggagaaggagcgtgttgaaggaagtgccgcacttttaaacatcagatctcatgagatctcactatcacagaacagcatggggaaaatctgcccccatgatccaattacctcctaccaggtccctcccctgacaggtggggaattacaattcgagatgagatttgggcagggacacagagtcaaaccatatcagatgttaaaaccttttttttcctttttgagttgtcagttttgaatataattatttcaaaaatttcattttgtttccttttcaaattctgcctagacatttttaatagcattttgctcatgttttcaaatccatcttttatttctagaaacattttaggacatttcatttatattctgactgataattcttaaattcaagttcttgggaagtctaattctactgtttgttgtttccactgatggcttgtttactctgtgtaactggaaacttttcattgtgaagtcatatgtggttgattttaatctgtgagaattctaaagagccccagctgtgggaacattcctacaaagctgattctcttccgattctgctggaatcctgagtctctctcaaactggaattatcttaacaattcttttgcttgaggtttcctggacggcatatgtggataatgtgagtttaagccctaaaccttcatgagttcagaattctcagcagagacatttccccacccccagccaaggccagaacaatttctcatagcagtttttctttgccaaatggatttttctagtccatcttttcactgagggtgtagatcttcaagattcctggcttttgcagactcttaatcagttccgttgaccttgtaacagcgcccaagtcctcatctcccattccacaatgcacccctccctactcatccctgttgtatggcaattaaaactgaagctttcagtttctgttatctgcacacactcccaaggcagcccatatcttagatcctcactcaccaccctggtgtcagctctctctccatttttgcctctgtagagacttacattcaatttttgtgagcttagctacatatttaaaaggttgttttttatattacattcagcatttctcagtgtctgtaattgggagagtttctccaaatatctattcttcataatactagaagcagaagttcaacaggccttctctatctgatgcttaaaagctagcgaggcagtcatttcagggctttggagaggtcctactctgttacctcccagcttaattacaactgaattttctagaactaaaaaaaatgtttaacatgagcagaggtgaggtgaggtgtcaatcaatccattttcacaatatgctaccacctactattcagtggacttgctaaaaagtcacctagcagagagagctttgccactttgttatgccaaaggatcaaataatgcagaaaccattcattcatacaataaatattcaccaagaatctgctctttgcaaggtacaaagtgctaggcaaacaaaagtgattaaaacaggaacttggccctcaaagagtttagctagaatgcctaaaaattttcttgccttaagtgcaaattgatcaataagtagagattgcctggagcattgtattaagaatctgaggccaggcatggtggctcacgcctgtaatctcagcactttgggaggccgaggcgggaggatcacgaggtcaggagattcagaccattccagccagcacagtgaaaccctgtctctacgaaaaatacaaaaaattagccgggcatggtggcatgcacctgtaatcccagctacttgggaagctgaggcaggagaatttcttgaacccagcaggcggaggttgcagtgagccaagatcgcgccactgcactccagcctgggcgacagagcgagactccgtctcaaaaaaaaaaaaaaaaacaaaaaaaaaaaaagaagaagctgaggacaagtctaaactagtgagtcatctgttaaaatacaaaccccactatgccatttccctgttgaagcacctctaatagcttcccattactcccaggttgtaatccaaactctgtggcctacaaggaggtcctcccagatgtggccctgcctgtctcccagtcttcctcttgttcactccattctatccatactagcttccttctgctcttcaaaggtgcctagttcattctcactttagctcttttgcacatattcttcctcccacctagaatattcttagttctttacatgggtcccacttctcatcatgagtctcagcttaaatgagacacactttgagagggcccttccctaaagaccctgtaaaaaggatctctcccaccatatcatttatctgtcacatcaccctttttaaattttcttcacagtccatatcagtatcttaaattatcaagttatttgtatattttctcatttattctttacttttctctatattctctaaatgtacctggcatatgtaatgggtgctctgtggtatacatatggatgaatacataaatggataaatggtcagtgatgtctgcaagcatgcaaaataggagggtggctctacttgtactacctaagtgcatcagaggaaaggtgacagtaacaaaaaacatcaactaagtgcaaaaaatgccgttaggttcaggagtgatgaaaggggacataatgaactctgttgggagcaagtgaaggacacaggcagggaaactgtccttgaaaaggcagcttaccaaagaccctaaagaaaagctggaagttactggcaggcatggtggaaaaaagcatccagacagaaaaagcacatgcagcaacaagcagctgtgagattcctccttacttcatgctatcaccctgaattcagggaatcagaacttcccaaagggttccagttttggcctcttgtccagagatgtccaggtggccaaatatcaaagtcctgtttcagactttcccattaactaatcatatggtttctaagagagtcattctacccctgggggcccccaccttcagcagctataaaaccaggatgtggctcgtaggtctctcatatcccttccatctctgcaggtctgttagatactcccgtgtttgctccagcacacattctgaattggccagtactggaactgtaaaacatattgattccttttggtgatttcttttgtgctggtttttgttttttaatgattaagagatagtctacagaatatcagtgttccactctgtcactcagttatagctaaacaaatcaattataaaattaagctctgaattttggtaaattccaaagccttgcacatgccgcctctggccagtctgaagtccaccgctccatatcactgaaagcccttctttagaatgcaggtgactgggtccaaccatttaccatccaaccccccagagccactgaattagcatctctcatgagtggggcccagaaatccacattgtcaacattggtaatgcccagttaattctttcttattcaccctcaaggagagaaccactacctcttagcttcgctctgttccaggataaaaacaaaacaataaccaaaacactaacagtggccagcatgcattgagtgcttcttatgtgtcgtgatttgtcccaggcttctgacttcctttcttgccccaacagtgttgaatcacttgcccaggttcacatagcaaccagctggggaatgaggatttgaatccatgttctttggactccagcatccatgtttccaactgctaactacactacagcagggtacaatgcttaagagcctcattcagctctagcatcggacttgatgagttcaaatcccagctgtaccatttactagctgtgtggccttgggcaagttattttgcctccttcagcctcagtttcctcaatgtaaggtgaggataataagcattgctacttcatagggtgcttggttgtgaaggacaactgagtaaaatgctgagaagggaacctggtgcatagtgagcgtcagccatgatgatccagcctccctttctccaggcttgggctccttggggcgtggtacttgtcccaaaggaaatctctgtcaagcatgagtagacggaactgaagaaaatccatcctctctgctggaaagcaacccacagcccatggtctactgacagtgggtcagtagtgttgtctttggagataaagtatggcacattatttgaacttgaatgttcaaagggcatcaactcctttctagcacacaacactttcagccttgctgcttctttttctttcatgcctcctaatggttctgtctgtcattatgaacctttcagctctgcttccacaaagcacaaagggatcccatcctttaatcctcaaaatagtttgtctttatagtttggcaggtaagagttggttgcagcagtaactcctgaaacctgcctctcattatgccaagaactgcaatgtgtttgccacataaaagcatgagtgataacaaatgctttccgatggtgagaactgctctttatggcctgctttccaagtgccctcttgacatagaagaactttttttttttacaacatcaatcatcattagtagcaaatggtgatatctgtatctgtccaggtgacatctcagccaaggaaggaagccacatcctgagaatgtcagctgttacctcaagactgaaatacagcaatagttacctcaagatagaaatatagtaaagaacttttgtctttcatgacagaaattattccataggtcatatttttactaaatcttctaaggaggtacttaaaattactttttcgttgtaaataaaactagttttagagtaatgcataatattttattcttttatttttgagacagggtctcactctgtcatccaggctggagtacagtggcatgatcctagctcactgtagattcgaaatcctgttccagtggtcctcccacctcaacctcctgatcaactgaactacaggaatgcaccaccaaacccagctaattatttttttgtagaggtgggggtctcacaatgctgcccagactgttctcaaactcctggcctcaagtgatgttcctgcccaggcctaaaattttaagtaagttcctatttatgaccacagatattttgagagtccattgccatgctagccttatgcaaattcagcgatgtacccatgaaccactatacccaccccaaaagctccacccaggggagacaaggcatctgaggggcacaagccccagcagaccaccacggatctgctgacctgggagcaaacagactcctcctcttaaaagatctacccactcagcaatacctgaactttgcaggagccagcaaacaagcacctcactccttggtaagactttccttttgctgcaccaaactggaatcttcctaccgccccaacctactgaatctataccattatttcagcaagagaaactgagcaaaacattgactacttgtgttagagaacaatgaaatattctcatcagaaaccctatcctagagaaggaaactgtctgcagtagagggaggagctccactaacttcgaacagctccaggactgacatcgctaaggtcttcccaactttatcttttctcactagcccccagagctgtccagttccagcacatggacatatatgaaaatacaatatcatatgcctcctccactgaccagggcaaaagctgcagtaaaagaactatcaagtcaaggaattatcttaaaatattactaataacattaccaaattacaaaaaaaggatctttaataagccttccatctaatgaagaatggaatgaaaatcaagaaaaaatgttgacagaatacaaaaagctgaagttcagatgctgaacacattcttttaatgttttatttatttattttgagacagggtcttactctgttgcccaagctggagtgcagtggtgcaatcatggctcactatagcctctacctcccaggcccaaatgatcctcccatctcagtctcccaagtagctgggactataggtgcatgccaccatgtccagctaattttaaaaaaaaaaaattgtagaaacaatgtctcagtatgttgcccaggctggtctcaaactcctgggctcaagtactccccctatcttggcctcccaagtagctgggattacaggtgtcagccactgtgccccagccgctgaacatatttagtcaaacttcttaccagagtaaatcccattgtaaccactgaggcaagcttggctcctcccagaatctgctttctaggctcagtccttcacatggtcttccttcttgtccccttggtcaccaagccatgcagcccttccacccttggcccatgcaggtataattctggtccctagcccccaaggtaaggaagcctcttcacttccaagtccccaaagtcacctgcctgggccactagccatgcagcagtaacttcatacttccctgttttgctcttcttgaaggttcctattgtccaaccataggccaggaagccctgctcttactaaatcaagtgttctcaatcaactcacctgagtcaaacaggccttaaaagtctacctatgccaatcttgtcatttacatgtaaggcagagaggctgaatgacttgctcaaggtcataaagaaaattaaggagtacaagccaagcctcctgttacccaggccagtggttttcacatggtaccaccgatgaagcctggggctgtagaccccgttgagccctgcccagtattccttttccacctgtcaccagtgctactgctaacctcacacctctaatcttctcgagagaaccactcttgggtgatatagccaccttgcccaagtatgcccgggaattatcacttaggaccaggttgcccgtagctcaagactggttgatgcaaagatacaaaattcctactttcctgcctcaaggaagaacacaccctgctatgattgatgcttcagagcatccacaggatcaggctcagaatgggcctcacctgaaagtgcatcctttctcctgagaatgctcgttaataactcattttgctaagattctcttatattcagctctgcttctagggaatctaacctgacactggggttctctctgagcattccaagcaagtatactggtccaggccccacagtgctcaaatggcctccatgacaatctttatccagagcccatcaacattcaatccagtccctcagtcaggaatatcccttgtcccttccagcctagaagtccactcttcctcctgagagaagcaccaagtccctccctcctgccctctcaagctctcacctgacttgtagttaggatctgaaagaaactctgaagtcagtgaatcatcaagctgaggtcatcagcagcataacactccctaaaatatttagtcttcggtgctccttagggagcagagaaatgcccccacagtgtcccttaatttgcttcttaaatggtgaaatctcttaaacagagaatgagggttttcattacagcattaacatcaccaacatgcagtggctcatgccagtaatcccagcactttgggaggccaaggcaggtggatcacttgaggccaggagttcaaggccagcctggccaatgtggcaaaatcccatctttgcaaaaaatatataaaaagtagctgggcgtggtggcacatacctatggccccaactattcaggaggctgaggcatgagaatcccttggaaccgggaggcggagactgtggggagctgagatcacgttactgcactccagcctgggtgacagggtaataccctgtctcaaaacataaatcaccaacaagccacccattgcttttgaagatactctaccctactttctcagaggaatcactgttcttgctacatgttctaactgatgttcttatctggatacaaaattaaaaaggtttgtcactctggagtaattatttaactatgacttgtttacataaaacagcatcctagaaaatgagtttgcactggtttctttcacagcagagatcagattattgacaaaatatccggagaacttataacctgctttgtaacaataatggctattcatgtatagtgcccaatatgttccaggcaccagaaatatgtcccttctaatccttgcaacaggtggggacaatactggtcagagaagttaaataacttgatcaaggttaagcaacaaatacatggtagaaacaggatttgaacccaggtctgtctacccacaaagcaagtgactgggccacttcaccacctctacctcctgttctccagtgcttgagactggttctaccctgcagcagttcctgttccaagctaagcttcgtacaagaattaatggacgttctcaaaagtacaccctgttctctgaccttgagagaggaacaagaagaagagcatctggtgtagacaaatgtaaggatcaagaggggctttgacaggaaggcagagtaaatgttctcttccctgtttctcccataagtctagctaaaaactgagcattagatctaaaacaagcataagaagacaccgaaaggtggggagctgccaagtgggttaaggacctcaggacccagggaatgacatggcaacgagttcctgaattttctttttccctcatgtatttcctcatctatacctgaaaagccagcaacctggaaacaccaatacacatagaccaaaaacaaataagcaaaaaaagctcctctctttgtccaaagaaccaggaaaggggcagcctagcttcttttagattgaagaaaaaaatgaaaacttttagataataaccactctactcgaaacacaccacacacacacacgcacacacacacacacacacacacacacacacacacacacacacaaaactgtggacccacccatacaagcaaagacctagtggggaacctagacagtagtgaggagccccaacacctccaccaggatagtttctgagaggctgagtgtggaggctggcctttcatctctgctaggtggcaatgtggctgcaaaggtgtcagaggaggctggtggagaatcaggtcttacccgccaccactcagcagtaatgaagccattccaaccgtgggagtggaggtcacatggagaaccataacaggactcctcctcctggcagccagatggatatgggtttcaaagagcaactataaatgttcttgaaacaaaaaactacaaagaactagcaaagtaatgagaagtatcagcaaagaaacagaagatagaagaaccaagtagaaactttgggactgaaatatattataaatgaaatgtaaaaaaaaaaaaaaaaactcaatggatgggttcaatagcagaataaagagaacagaggccaaaaaaaatctgtgaacttacagataaaacaattacccataaacaatcaaaataaattaggctggggaaaaaaatgaactaagcctcagagacgtgttgaactacaaaaaaaagatgttaaaggtaggtcatctgactcccagaaggagaggaaaaagagggtagggctagaaaagcatttgaagaaataatggctaaaaactttccaaagttggcaaaagacagaatcaagaatctgagcaccaaatgggataaacccaaagaaatccacaccaagatgcatcacagtcccacaaaaagacaaaggaaaaagccttgacagtagccagagagaaatgatgcatgaagccataggggaagaacaatttgaatgacagaggatttcgcaaaataaaccaaggaggccagtaggaagcagtgcaacattttttaagtgctgaaagaaagaactatcaatccaaaattctatatccagagaaaatattcttcagggatgacattctcagatgaagaaaaactaagaggatttgtcaccaggagacctgccctaaaataatgactaaaggaagttctctaaacaaaaaggaaaagataaaagaaagaatgtctcagaacatcaggaaggaagaaaaaaacatggcaaaaatatatataaatacaatcgagtttgctttgcttctcctcttgagttttctagattcagttgatgattaaaaaatcataacactgtctaatgcagttctcaaggtatgcaaaagaaataagacaatcatataattggaagggtaaagggaggtaattttctttttcttttacttttttgtagcaacaaggtcttgccatgttgcctaggctggtctgaattcctgaactcaagcaatctgcccgccttggcctcctaaagtgctgggattgcaggtgtgagcccctgtgcctggcccatgtctaggtttctatacttcgctggacctaataaaatgacaataatagtaggcaatgataaatcatgtatgtctacatgtttaaaaagccatgtcaaaagatacactctaaagcaatatagataaatcaaaattggattctataaaatgctcaaagaacccacagaacagcaggaaaaggtccaaggagaaactgaagaggaggaatggaggcatctgcccctccttctgccagggtcactttaaaactagacccttttcacaaggtggggagcacagtcatttctgctgttctgggggtacatctagggtgggacagggatgaacccaccaggcttttccacagagctttgccttgcattggtgaatgtgtgccctggtgcttatggaaggctcttctcaaagcccgcaggctgacctgccagcacacccaaagtggctccttgtcaaggctcagggtctcagctcaccttcagcatggtggagtttccctcctgggggagaacagtacatttgcactctgtttacaaaaagccaaaagctatgctttgtgtgcaacctatctgctggaaaaaaaaaaaaaatggaactaaggtgtctttgagaatgatctgatgcagctaggtcagggggaagaaagaaacgcaacaatttggagcagtgccccaaacgcttaaatgagctgggtacaaatcagtcagcgttggtaaactctacctatagatagatataatatctattttataatagatagattatatatttataatatatatactatatattatatagatattttataataggcattttctgacttagaaatactaagacaaaacagatactaagttccagagaacctccctttaattttattagggacaggagtcctgaatccttccaggcaagaagatagccccacagtcttgtagtaaaccgtgtgctgctgtgtttctagacccttaactttgtacctcctagaagaatgcttctaaaaactttcattacacttgttgataatgtttacactttaaaaaatacatatatctgggaaggtatttgtacacgtcattcattattccaaatataagggtatttgtacattacatgtcattcattatttcaaatgtaattttaatcagatcaacataaaagcatcttaatataatcagtagtggcactggtaactttaaatattaaaatctacaataggaaaaaaggagctttgattcattgtctcttttcaaattagcacaatcaacttagcacacacctctaacctttctttccaacctctcatgttctttctgccttttctcttgcttctcactcccccagcccatgatataacaaagagaaggctgtagagggcagagtcagggttgacaaaaaacagattccaattattccttctccttgcacgtattcaaaaacctatagccttttataaaaatatttcgattttttcccaggaaatctactttttatgtttgccctgtctttagccaactctaatagatttttctgttgagttctgatctgtacctgagattcttaagaggtatatttgcagacaaaaccaggaagatttccctgaattttttggaaacaatcttccttacaccaaaaagtaaattgcccaaggaagcctctcccacctaggacttcctaagagcagaactggcacttgtaaaaactcaggaaggttgcaaaaaaattggaaatggggttccatggtttcaatataacgttaaatttgaaaattaacgcctcaagttaatttggctctttctgtcttgagctgattagtgaacactagaattcatgctagagctcccaaaccatttgcctgcaatgcagggctcatgttccaaattctgctttttgcagtaaaaaataatatgctcacatcatttcatgactgtggtgctacagtgtttctaccggcttgcacgcctcctacgggtgggctgatgtttattgtattagtacataatgctgcaactttccactggcacacaaagctagtggttttctaaagcagtcctggaattcattaccatggaaacaaaaggtataaaaagctgtttttatctaataggaaaacttagaggaactctaaaaaagatcaaaagtgttttcaaagtaaaggtagagtcaaatacattaagtttaggttaaaggagcctcggaaaggaatcgcaagggttaacagaggaaggaggcggactctgtagtgatgggagaaaactcagcagcgccactgggaggctctgaaactgggacaaggatggataagtcgggctgccgaccaagtccacccccaaaaaagtggctgaaagaacccaatactcttcctctgccaaggtacaggagacatggttagaactccagtctctccccacagaggtgaaaatgagtagtttgttcttcggacataaataatatcatacacaccctggtcctaatacatccatccaaccattctagactctagattctagacatggaaacgagaagcaaatgaaaagcttaatataaatatgttcattttatcaactcatcatttgatctagagcttgatctcatgtgttcaggaaatgctgtcacaggtcctattttagtttgggaaaggagtaagcgcaaaccacaagtatttattttggtgtttacggtgtttccctaacatccaaataagttcaccacatcctgccatcagcttcaaaatagaattttggatatattcttccttccatggaaaacttcctgatacataaactgctctgaccatctgtaataatacaaactcttatccagtatcctcctcagaaaacatctggaacaataggaagctcccatcaatgctgctaaaggaacacaacgtttctggaagccatgtgatcattccggcagcagggaagatacatggggtcacaggcagtcagactccatccttgtactgaggccactgcccaccatgggtgtgctggccagcccatctgccattctagccagcgatatacggagagtatgaggcttacagagctgaagtcttctgcattaaaaggcttaattttcctgctcaaaggcagtcttttagaatagcaaggaaaaattattttaacttagaatggggttaaactaacagcaggactgtgtttagagaaaggaaaccatacagaaataatttgaaaacataccatctaaaaggcagtaaaaagcaatggttgaaagcatggacttttgagtccatcagacacataggtttgaatatcacatgcccacttactttccatgtaaccttagataagcctcagttcctcatctgaaaaccatacctatctgacagaattgttgtaaggatccaataagatcaggcgtgttacatgtttagcatagtgcctggcatatgggaagctgtcaataaacattacctcttgcactgtttctgttacagggagcaggtgatgtttagcctggagaactgaaggctcaggaagaacggggtcttcaaacacctgaaggactgtctcatgaaaaagagatgcacaagacaggagaattgagcagagagatgtttaactcaaatcgaagaacaaagacagcattgaatcaccacctatcaagggtcttacttgaatagactttggtttggatgagaggctatagaagaaaacctcaaaagtctcttccaattctaaggtttcatgattccaggcatttggagaattaggaaaaataatcacttaaaaaaaaaactatttagtgccaagcttcctaaaacatctttaaaatgtccaatatccatgaatcatagggtattatccattttatttgaaaaccatggaactctactactagaacttcattctaggttgtttaaaacaaagtacaatgcaaaactgtcttctttcataagaaccattttctagatgggcatagattctttgagggaattcttatcatgcagatattttacttcaaaatctaaacttgtaccactttactggaatgaaatattaacgctattaatttaaacatcataacattttttaaaaataaggtgttaaaataatatttattcatcaatcctataccactacaatattttagatcagtgatttaatatctgaaaaaatttatcacatactatgcataccactgatcagcagaggctgaaattttactgtaacttcagtccaaagatacaggttttaatttgagttctccataattcacagaaatatttaagggtaaatataagtcttaattaaaatccctattctcccagcatgtgctaaacccaccctgctccacatgcagacccttggccccaaacaatcccgagaggatgttggctcagagcagcaaggagctgacagatggggcattcggtaaaggagtggtgctgggttttttcatttttgttagagacgaaagctgtgggaaaaacattctccacttaatctattttattttcagcaaggttttacctgtaaatattaatttatacaccagcaaaactcactagatgcctgggctacatgaatataaatgaaataaagctatccaaactaaaaaatgaaatttcctgtatcttcctttctcaggcagaggaaaaatatccaaggatttaaaattctatccagtggtttcaaaggcaacaaaagatctcacattgagctctcatttaaataggtggggttaaccagggtagaaattacaagttaaagtgctgcagcataaagaagaaaaataatcatttatgccattttcaatacagaatttatttccaaatcaaaaccctttacacttggaatattgtcaaatctcaaatttttaccttgctgagatctacgaccaccttttgaaactgagacagtgtaggtatgattactccctgtatactcaagggttaggaaaatggaaaagaaccgtgagcccctcaagaatggtggcttttcttattggaatgaagtaaataaaataaattcattgacaatgcatttaatttctttcttagcaattaattgtgtatctacattgaatgataaccgtgtaaacagtcaagatatgcatgtggcaaatgaaaaataaagcaaaatgttttatcctgagttacatggattcccagagtgcaacggatggggaaagggttggggggagggattctcctaggtttgataacactttccttaaattcaacagcaattcacccctgtttagctgttctacaatgctgattaagagggtacagcattgtgccctctgggtgctctgtgctcactggcttgggtttttactgggacccccagttttgtgtccaatggaagttgggaacacagcactccaaccttccccatttttaatcctcctagagactcctaaaataatcctttgaagttttgtcatagcagagagatgctgtgagagggaaagaggtttccacatacttccacccccacatagctgaacatgagctggcatcaggtaaaagttcacaggattcccagtcttggaagactcttcctcctctcccggcctctcagtttgcacactcctatccattcctttaagcccagcccagcccaatcccatattactgcatgaagccttgtgctatagaatgaatgtgtatcccccaccagaattcatgttgaaatcctaaccctcattgtgatggtatttaaagatggcatctttaagaggtaattaactcataagcgtggagcccttgtaagcgcccttacaaggagagacaggagagagcttttcttatctctttcagcaccatgtgaggatgcaacaaggagacagcatctataaaccagggagagggccttcaccaagaacccaccaagctggtaccctgatctcagaattccagcttccagaaatgtgaggggaaaaaaaggctattgtttaagccacccagtctaaggtattctgttgcagcagcctataacagagctgattgagaaaccttggctgataactgcagcttccttggatgaagtcagcctctcttttaaaccccaggaccacactgtagccctttttacacggttttatattgctcgtggttattttacaggattttggtcatttcccctcaactacagtacaagtaacattgatggcttagagtcttcttttctttcatattatccactacaatgtcgaacatgcggcatatacctatgggatgctgcatagacctgttggtgggttgattgaatatcacctgcctacctgtattactaagttacagaaggagaataggtgggttaaatgctagcatctcttacactattctacttctcttgatgggggaaaaaaaaaagatttagcacttactgggtttagaagctataccaggcactgttcagcactgcctcacaatgctaggataggactagaccacattaaactctgcactgatttctttccctgtgaagtccttttacatttgagcaaattatccatatttgattgaaatgagaatttactagggcataattgatatgtttgactgaattagtcacattttaaacaggtggcacaagataggtcatagtgtgaatcagaatacatttagttccactgtttttctgattgtcctaaaatgaatgtgacttctagaacaagtacttctgaagccttttagtgctttcatttctgacatttgtatcagagatgataggaattagtgtcatgtcagccatctctggcagaaaaaaaaattattccctcaacaaaaggtaacattcttcatctggtgcaggcctgtgtttctgtccttaccacacatggaaaagaaagggaattccaacccaaaggacaggcttgagggctgccacccacccctggggttattcagctgttcatgctcaaccacaactccaccatcaaacctgtggcctctgtaagccagaattggtgatttttttctttttcttttttttttaaacaattgaatcctaagggtatttttcttttggcgctgaaacgatattaaaatttactgcaactttatttaaaaaaatagaaaactaatgtttctctgggtcttccattttttgaataaaactgactcttaccacccaacacatggatttggaaggatagcagtacaccaccttcttagctcacttggctggaacatgagctgatgaagtcctagtctcaagtttggccttcaagaaaactagataggcttgccctatgccagagccaatctagacctgccatcagttctgtttcttctttgtgtgtgtgtgtgtgtgtgtgtgtgtgtgagagagagagagagagagagagagagacagacagacagacagggtctcactctgtttcccaggctggagtgcagtggcatgatcatggctcactgtagcctcaaccacccaggcccaagtaatcctcccacctcagcctccagagtagctggaactacaagggcatgctaccacacccagctaattcttgtattttttatagatacaggatcttgtcatgttgctcaggctggtctcagatgcccaagctggtcttgaactcctgggctcaagtaatccatccaccttggcctcccacagtgctgagattacaagtgtgtgcaaccacacctggcccatcagttctgtttcttgaccaatgactatacctttaatgctaatctgcctttgttcacaaaatagggcaagtcagtctgaatggctgagaaactggaggagaggtaccactcaaaatgaatatcctcttaatagcagatgtaaatatcttcctcctcattatcatcatcataacaaacatttatggtgcctcctatggagcagggattttgcttaggactctgaactatatcttacttgtcttcattaaaaaccttatgaaaaaggtactattattaactggggttttttgtttttgttttgtttttgagacagagtcttgctgttacccaggctggagtgcagtggcgcgatcttggctcactgcaacctctgtctcccaggttcaagtgattctcctgcctcagcctcctgagtagctgggattacaagcacatgccaccatgcccagctaattttgtatttagagacggggtttcaccatgtttgtcaggcttgtcttgaactcctgaccttgtgatccacctgcctcggcctcccaaagtgctgagattacaggtgtgagccaccgcacccagcctgggttgtttaacagataagaaagcttaagaattagagagataaattatcttgcttaaggtaacacagttaacaagcattaggtcaaagtttgaactcgggcagtctgactacagagcccaacctatttcatataattcatattaatctattttactcacgagtatcagcaccactagataaatacgttaaaataatctataatttgaacagacatctcctaataacaaacataatatctataagtcgcaaatatctaagaaatttacatcagtatgacatggtatttgttctagaaataatataagttcaaacactctgagatgagacgataaatcactctgaaaactaacaaataaaattgccacaacataaagaaatagtacaagcactagtcaaagctagaggtcactctcaatccatgtgagaggaagcaagagtaagacactagagcaagaataagtcaccatccacatgtcccaaagaagcctcagtggcactgcaggagatacagagacagatccatggtgtccctgaagctgggactaagccagggctgtattacaccaaggaaaccagcctccctaatcccagagggagccttgaagcgtcttagagggagactaatggccaacattgagaacacatgtctattagcttgctgagcctaatgaagtaatacagcagagactgacctcattctagaaacagataacagtggctgtgcacaatgctatgcctagacccctacaccttgccagcctggtgttccttatgtattcaagatacataaagattagatgtgtagacgcaggttgtgaggacagtgtttggggataggaaaagcccccaattacagctaaaagagatgtctcttttgccagaaagtgtgttatatcaattaaatgggtaaataagcccttttcccactgtggggaagcaagggcctcttgtgaccctctattgattaagactgctgtggaatgttatttgcaatctcattgcataatggaaatcaggaggtagctgtcatggtttctgaagacaaattgctggtagctgagacaaatcatagcctctttcatcttttactgttctcaattcccaattaatgtatatcttacaatctaagtttcttaaatcagtctgctctactgtctcaggtagtaaaaatgtgtaaaatggtaatctgcctgaccctactttaagaaattgtgtttaagtgaccattgcactgatcattattcatgagctatgcattacttaataaggaacacaactcaaaaatgaacacaattaaaaataaatccacacaacagctgctgtgattatgaccaatatgaacagaaatccaaccaggtgtgtgtcaaaagaaaaaagctgctgccagacagaacactgttaaatctcatttttgttttgcacactttgacttgctaagtcagccagcaagcaatttgtatggagcagtgcttccaaagtgtgatgtgcaaaagagcagcatcagcatcacctgggaaccattagaaatggcagttctcagaccccaccccgggcctccccggacccactgaatcagaaactctgcaggtgggctcaggaacgcgtgtttcaacaagcactctgggtgatttctcgcatgctacagtgtgataaccattggactgagcacaggacagccttcagattttaagtcttcctaggaaggcattacctttggttgcaaacagctatgagaagagcccaggaagacacctgtgttaaaaccgctgcagtcttcaattgtgctgtgaacctaaaactgctctgaagtgaagtccataaaatttaaaaacctgcagtctctagggtgaatgggtagaaagagcacagtactttccttatgcagatttatttacatagaccctgacttattctagaaaggttttcagacaattttgtaaaccaaaatatataacatccagtcacaaaccattcttatggaaagacttctcactacttttcaaacaacctcattatttaaaacaccccaaacataggcatttatcactaaaagcacgctcttaagatgtcttcggtattcacttcaggatttcaggccatttaaggctaggggaaagaaaagaaatttaaattcaccaagtttaaaatgtgctccgcccaagagtcatggtgctccctgaactgtctgagcatatgaccaccatgctgattctaagttattgcatgtttcgaagagacatgacttggaatgttgtgtcctgtgaccctgtcttacagcaagatgctttcagcaattcactcatctggcccctttgttggtccaagaaagggccctacaccaccaaaattcattctagagctaatagtattcggatgaggctctagcattgtttcaactgtttttcaaaaaacaaatttgaagagcaaagggaagtaacttgtttatcagagatttgtaaaataaagtatggtccatccatatgattaaaaaccaagcaattattaaaaaaataaagtcctgcagttctcattcttgaccaaacatcagaatcacctggtgatcttttaaaacataccaatgcagggctctacaccaaccaatttaactggtcctggctagggtttgggcatccataatttttaaaagctatgctggcaatgctaacatgcagccaggatcaagaattactgcagtacatctgtattaaccaacatggaaaattttcccaaacatattaagtgaaaaagaaagtcataaatcacatatctgttaataaaatcatgtgtgcatgtgttattaacggatttatgcatttggaagtggactttcctttcatactatgtattgcttaaaccttccaaaatgagaatgtgttcatatattttgcttattttactttatttttgattgacaatttatatgtatttatggggcataatgtgatggtttatgtttacaatatggggtgattaaattggctaattaacaaatccatcatctcacattttttttggtgtatggtgaaaacatttaagatctactctttcaacaattttgaaatatacacgcaatttcttaatgttaaaaatacatttaaatggaaatttgtaggaaaaagagaaagcacatgaaaatagcaactctcaaaatataatcatgtttccttctttctccgcttctccctattagtctgctttcacactgctataaggaactgccagatactgggtaatttataaacgaaagaggtttaattgactcacagttcagcatggctggggaggcctcaggaaactcataattatggcagaaggcaaaggagaagcaagaaaccttcttcacaaggtggcaggaaggagcgtgccaaacaaagtgggaagagccccttataaaaccatcagatctcgtgagaactcactcactatcacgagaacagcatggagaaaaccacccccatgattcaattacctccacctggtctctcctttgacctttggggattatagggattacatttcaagatgagatttgggtggggacacaaagcctaaacatattgccctcctttttctaaaggagtatacaagaaaaataaacaaaattatacttctttcctatctattcaacacatatttccaacattgagattgggatgagggagagagtagagagatatgatttattcattcattcattatttctctgacaggcccatgctaggtgctaggaatacagcaacaaactagatagacatgcccctgcccacatggtgcttacagtctagtgggggatgcagacaagtaggtaaacaactacaacccagtgagagagacattaaggagaggaagcacaagctgcttgttacttgtaacaaagagacaatctagtcaaggaaagtgagaaaaggatccccaaagtggaagtggaccttcatcctgggtaaaaccctagccattaaagagttttaagaaggggaaagagattaccaagtctccattttgaaagatctctgtagctgggagtttaagtgctacttaccagtcctctctcacctaaggagagtgagctcttttcaaagttaaatgaaaccctgctacagtaccaaagagttgactgaagaagtccatctcccaatattccattatctattgccatcaaatgagattgaacatgaaatttacctcctactgagtttactgactgcactcatttatgagttcatctctagatgagcccggatatggcagatttaccttttcaaagttttgaagctaataaaacccattgtatgcaataaataactcaaaaaaatgcttggctttatagaagtggttgctacaattggtggagtctcttggaagaaaatatatcttcataaacatagcagggtaggcgaagactgccagggaaacaagctgcttctcagtatttcattgacttcacatgaagatcaattttagccatttataatcagcacacttccacatagggtgaaattatctagcccacccacaaatggatttctatttaaaagtctcatttgattgctttgggaaggatacactacagactatctaacccctatccttcaagggtagaaaattaacaatccaggtaaagttaactagaaaaacaaaagagagaggaattatatttgacagtgtcctcttacaacccagtgcatctttgtggacattaatgtgagttacctccagcatcaatgtgctatttttaacttagaatattcaatctttgctcaaagtaagacatatgattagtgtttggagtaatcaatttgctttaatttaaaggagagcagaggaaatgttctagaaaggagaaaaaatttgagctctttataaaacacaaatttatgggcttctcaaacatttccaaagaccctctcctttttaaattctttcaaaactacacaatctcttatggggagctggacccctcttttcactgggttgtctgcagtacaaaagcccctgaggtgtcgtttatacctctgtataggatggagctgttctgggtctgctattctaccgttacatgtcacattatcctaattgatacttctgttatctaaagccattagcatgttatatgagtgaagcaatcacctaggtctgctctgccccatgttagctgatatacgatgtgtgtgtgcatgtgtgtgtgtgtgtgtgtgtgtgtgtgtgtgttagggtacactagtgcatctaaaaagttcagatcattaaattcttgttctgtaactctcaaatttgtttccactcccaacacacctgagggatatgagacactcatctcaataaaaatagttcccagagaggggcttgggaggcacacatcattcactggatcctgccattcgaaaagcctcccaggtagttttaataatgcagcccacaccccttgtgggtgaggcaacagcagtatgaaccccaccgtacactcgaggttgagtatcactaatctagtaaagcattcagtatcctatggatctacgccacatggcatcttctgttcccaggttgtgtccagctccaggcccttattcaaccctcttctaaagttaaagaggcccatttttttcatttgcttctgagcttggataagaaaagaaacaaagataggatgacaccacttccctctaggtcagatgagcagggccacctgtattccagcagaggaggtggctatccactaagtgcagtctctgttggggctaaatgaacctccccaactgatgccagcatctcctttgcaaagacaaatcccatttaattccacaattagtgatcctgaaggaaataaaatgctcctctgacttaaacacagacatactaacatagagatagctgacaacacctagatcccttgcatcaggttttgattaggagaacacttaggaatacaaggactggagaggctgacacaggaggagcaagactgaagaaagtggtaaatggggctgcatggaagatgttgtctccttcacattttagttcaggaagatactgcaggtaaaatacatggccttcctaaagttgtccaaaaaaaggaaactgagacatttagggatcacttccaaatttggcccaaatattttccataaaattttaaacacatcgcaatcacattcttaaaaccccaatttatgtttattgttgagtaggacagtgagtaagttcatgaattaagaccctgtttgtattccttatgatcaaggttcattgcatatcttcagtggagatgctctaccttctttaactccattatctgggaataactagcaatacattaatttctgggcatatttttagattctgtgggtcttttgctaccctgaaagggcctaagcttgagaaaactgtcctaaaacttacttttactcaagtcataacctttggaaaattagtatttaagaaaagtattatttttcaaaaaggagctatatgccaatctccaatgcattaactgctaatcattcctctgataactattctaatatttcatgtccatcctagcatatatgtataaacagaagtcatccatacatagagtagacaattttctatcccaattgctttataattaatactacaaatggagtgcttcctgaaagtcacataaaaatcaaactaaagtagcataagttgctattatctaattcacattcttatggttccagaatcacctgtaagatggactaggcactgacatctcactgacggacttttgaattacagacgattttcaagtccaataacttggttaataactagatttgcttctgtaggttaaacgcgcactctggaccagtgaaccgatcatgttagtcatgacatctaccataacagcaccccctcctggcgataagtgacccacccactccctgcacttcagttaagggtagcaagagctgccctttcatgtgttggtgggtgtctcaagagatggcctggggcattggactctgcccagagagtcagtagtaaccctctcacccagtcagatggggtccctccagaattacccaagaaattaagagaactaaccagtcagtgagggaagaatagagaagagagaagccagatccccgctgcataaaaacaaaacaccctcttgccttcaggtggcctggagtttccttcaatagcccaaaaaaccaaaggacatgaccaggtcctgatggaagccttcctgcattttctcattaaatatacccaacaatctaacacaatcttattattcccattttgcagattggctgattctatggcaaaaaaaaaaaaaaaatgcaaacaagcttggaaaacctcatatgaataccttatctcctccaccacactcctcaaatctttgcccacttttggctgggcaccaggctacaggaaacagccaggattcacaggaattacaatggtattgacaggaacccgaattggtttataaggagagggaaaccaaaaggagaagattcttaggaaacttttcctctcctctaaaagtgatgtttttgaaccacagttgctaagttaaaaatagaaaagagatgccttggagcaggtgaggagggagttcaaatcagagagaagagttacagaaatgtctgagctggacaccaacccagagcagaaaatgccatatggcacagaaccggggtagctgggaggaatactagatcccaagatgtgggaggaagcctggagaattctggttccacatcttccctctaagcaaggagtccctcttactaagagaaatggttaacaactgcctagtttcccttgaaggtttccagaaatggagaactagagcaactctggctacatgttttaattgtgtccttctcactgtcaagaggcgcttcttaatgtcctgctcaaatgtctccagcacaccctgaagcctgtttgtgcctcttcagtactccttagacgcagagagcttctgcttagcatcctccttatttgagaaaatttcatctatctgaaaatagccattaagttgcctcataccattttctcttctaaactagggaaatccatacagaggctgcacagccactcaagggggtgttacaaagaggattccagtgccatgagtgggccagactagatgtgcctctgagatatctgccaagccagaaatcctttgattcaattcctttcatcttttgtgtgacatttcccatcactttgttcacatttgtcacaatacctgtcatctgtccaacttctccatattcttttaatatttctaaatctaatgtgcataggaccttttttttttcttttttttttttttgagacagagtcttgctctgttgcccaggctggagtgcagtggcatgatctcggctcatcgcaacctccacctcccaggttcaagcgattctcctccctcagcctcccaagtagctgggactacaagcgtgtgccactatgccgggctaattttttgtatctttttagtagagacggggtttcaccgtgttagccaggatggtctcaatctcctgacctcatgatccgcccgccttggcctcccaaagtgctgggattacaggcgtgagccactgcacccagccaggaaccatttttcacaatataaaacaaaggctcattaattcagattaagttgaaaaattcatgtccccctgagtaagaaaccagagtgaaagtattttcaattaaacaaattatgtctattacaaaagactacatattggttattaataaataaaatgagaaagttaatgaaaatggtgagttaacaataactttatttttactgcactttatacttttcaaagtatttttacatatattattccatatttccaattttattcaatatgtaaatgcaacatatgggtaatagatcaccaaacctaaatcaaaaagtctaatttatcctgctaaatttgaacttttaatgcaataagaattatatataattattccaagtctgtatcagagcagtctgaattaataaggttctgctctattgtagttataataagcctgacaattttatgaccatctcatctcccagagtgtcactcccatctacacattagtaataaatactgtttcttcatgaacaaacttttgtcataacagagcatcccaccttaaagaagtttcactcagtaaattaaatagctcaaataccatagaaatgttttccatgataaatgcgctgagttcattattctcttcaaaaatgcttgtttaatttaaaatgagcctaacaaagaggttatcccaagatgacaaggacccaatatatcacagaacttttcacctttctctttgttcaggaaaaaaaaaaaagagtcaaaattaatccagttaattgtaagtaatggaactaaaccaatacatgtagaatgccccatatagaatgtcccatttgaggaacctggtaacaccaaaagggtctatgagcaccttcaccatcttcactttcttcttaaacctgcagtaggagtcatagcatttcattgttctttcacaatggtcagaaagacaatgcctttacctaccttaaaaagtcttaaaatgttagcaaccatgatggacacggagcttgctgcagcacctatgacgccagaaatcttgtcgggcttggtgaaaatgggtggatctccattagcacacttcacatccgaagcatctttctctattaatgcctgcacgaatgttagagactgctccaaagcataggtgtccctagagcacgtgtcgaggatgcggacacccagagtgatgttggaaaggagatcagggtccttgttaatctggtcaattgcataaagcatggcctccagtctgtgaatccccttttccttcttcagctccccacaaggcacccctctctctccctttgcgtggacagggaagagaccccccaaaataatgtccccatccacccgtatggaatgggcatactcctggctgtgagttctttgcatcattgtgaggatccagtagaacttggcggtcaagaggaagaaacaagggcaagaggctgatcgctttccctcgcataccattttctccacaggtggtattgcaatccaagacccaaagtttattcttgccacagaagaaagggcaccacctgaggctgcaccttctggaggctaccatcagggcccatggggaaaaggctctgtgggcattagcaagttttcttgatttgaatgtcacagtgaatttccatcagacccctaaggttcaattttatttccttataagatcaacttgcctggaatggtgcaaaaattagaacatctgaggttctgatgttgggatgaggtcaacaattcatgtccttgaaatcagccttgtagcagaattattcctgggaagaggggaaaaaagggggttcagttcagtgggtctacatgtttcacattttgcagccctgtttacgccagcctcttaaaaaaaaaatcccctattcagtaagaaactaattctttttgtccccctgtgattctgaacacctggctgcactgcatctaaacagggagattgatcatatttttggagcaagagaaacagaacagtatcaggaagtaggttgattctcccaaaccagaaagcacttttatttatcatcttatttcaataaaccttatttccatgaaggtaaaaatcctgcaactgatggcaccatttcttttcaaatctgttttttttttttgcagctatctgaatttagcattctaattttgtcaacaaaatcataataaatattattttctgtgatgtattcaacaagccagtcatctgttaatgactttttttttagtgcctcaaattacccagtaggaaaaagtgattattcaattacaaagtgaaagagagaaagaaatccacccaaagagctaaaaaatgtgtaagttttgtagcttgtgaaaaaaaattaacatagaaagtcagctatttcatataaattgtcttattctctggtaagaaaacaaagacttgaaaatgaaacacacaggtaaggtgacatgtgaagatattcctattaccattgtcagggtttccaattaatttgtcggtgtgggagcaatgggtatattaacagttctgagggaaacatgccttgatcccagaatcactaggagcaaatcagagttgtcaatcaattgaagagctgcctaattttgcctgactcagtggggaaaagttcatcaagactagaaataacttgaagtgaaaaaggctacacgcaaatctacagacaaagcctttttcctacggccttcacccttaattccgtaagatttttttcaaacgacttttgaagagatgtgactgaaaatgagaactgacttaacacagggaatctgagatttgtaatgcacagctaattaagagaataaacagcaccaatttactttggcaggatggttaatctaatgctcatttctaacctatttatatatgggtttgaaacctgaaatttggacagttctcctgtaccctagccaaccaacatctgcttgtattttccattcacttgttcaagttccagttcataaaattttctttttatccttcttgccccgaaaggaaagatggtgcttccctgggggataactgaaaatatgcccaaacaccttcaaagaaagctgcattttttgcacttgcagattagaaaagagggctcatagcagcccactgccccatatttctgagcaaacacctggcagcctagccagccaatggcccactcggctgagatagttctgtgcagcctaagacaagtattccctgcctccgggcacacattaagccttagatttcctctgtgctgcccccaaaatactttctgatttttctcaccacttcactgtttagtccctcacactggattctcctagcagctgcttttccctcagaaaatctgtgattcaataacagcctgacctcaggcattccacaaaaggaaacactcagaaagtcaacctgattttctggatgaaaccatttaagtgataggccataaattacaccggccacccattaagagaagtaagattgtgtttaacagtttcacaaggaaaaccagtcacatgatagtaaaacctcattaactctgatcactagttgagaatttgagaccaattccacgtggctgagccgacccttgttctgacagagtacagactaaatgaataaataaggtgaaggagaaatgtctagggggagtggatgggtcttgggaccacctttcctctttacaccaagccatcccccaagtacttaaaacacttaagagaataaatggctttcaattatagacgaacatacaaacagcccatctgttcatcacaatgcatccttacctatccatgtggcattaacctagttccacttgctgtacagtccagaaagtaataaaattgagtcgcttttaaaattattggtaattgcagtattgtttactctctttggcatctcatagctttgtttggagctttaatttttaaaaaaagattggggaatgaatagcagtgaggcaggaatcagttttgtttagtggctgaatgcactgaaatggaaaactagaggttcagttttggtttcatttcagtttcatttattggacagctcacttgaatttttgctggagtttccgtctctggaacacagaattaattgcatgtaacctctctgaagcttgcttttcttgtctgtaaaggtgatagaacctgccacacagcacacatggaaagcatagtatctggctcattaaacaggagttattgttgctaacttagtctgtaattcattttctactggagcagagcaactctttctgtatttgcccagttggtgagcttttactgaatttcgtttgtcactttaaaaaataaaatcagagctacttataaaatatttaaatcttccatttatttcaaaatctgatacattgtcataaaaatcagactccactgccagaaggtttagtttccccttttaaaaaacctaaggaaaaatatatttgaaagtttgtgagaaactacatcagttaggtttcattgtataatcttaaattacttatcttgctcttgtacaattcttgtgagctttaatccaagctcatcctagtggagtctgtgagttttaaacaaatcacaatctttcagagctatagatccaaatacctctattgtatgttttgtgtttgatttaaagtataaacagctcctctctcaaactgacctgcctctgacatgtggcagaagcggggactgtgctggactgtttcaaggaggcgtgaggtctggactcctgaaaccaatctcagagggggacaaatcctctcagcactatgtctgggcccacagggagaggccgtggaaccctttggggaggcttaaccatgaaccctcatagcccttcctgtgcactcccccgccagcccacccttacttacagggcacatcatacatcattgggccctccatgggcagtcccctggcctaagactcctggaagcaggcaccctggctggaccccgagcctgtatccccctaaatgtgctctgtttcctaaaaggccagaaggatacctcctcactggccagagcccagaattctgctttattttctacacaccttctctgtaccagtgtcaagtatctaacacagtatctccataaattttcatacaccaggcattagctcttgtataaatgagaaaagaaggctcagagggattgaatatggccccaacccctgagagcgtgagctgataagtggcagtgccaccaaagtcatctgtcccagaaggtgggtcctgtccttggagaaagaccccagtgctgcagggactcactgtggcagcacaaggaaagggaatggccctgcccctccactgcaatctttcagaaaggtgcacatcttcaatgcttagctctggaagaacactaacatattaattaggaagggacaatctgggggcatttccagggaggtgatttctgaatctctcaaagggctgagaagatccaatgcggtttgtccaaacacttctgctccaaatgaggtctcctggccaggttgatgtcaaggtgatgtcaggtggaacacacccaccaacgcatgcagggtctctctgggtctgccatcacatcttccttgggcatttagcaggtatgattaaaatatgatagggtaaaatcctcactgaggaataccattatccaagaattgtaatttttttctcataaaaaggccaaagcagcattcctatgctgcattccattcagctctttaacaaaaaggttaagctgaatattctcatcaattcatatgactgctcacacttgcagctcttttggttgttttgaaaatgcatcgtatttctgtatcatctcccatgctgcaatatgtgtgcatgtctatggattcttggtggggcagagtgaggatggggcagacagagctctcccttggcaacagacgcttggaatcggatctttgtctgacagtcactggctggtaacactgaacatgtcccctcacccctatgtgcttccatttcctcatctgtgaaacgagtgagatggaccacgtgatctctaaggtgtcttccagcttcctattctgagattctattacttaataataagggaatatgagattatgctcaaacatcagagcaaggctttgccaactgaacacaataactgattttgtttgcaagttgagtgactttttttcatcagtgagaggattgtgaaagctcttctacacaagccagcctcatattttaaaaaatctgatacaggagaagctcgacttactaaacagataaattggaaagtaattatttgcattacagaagaattcaccacaggtttcctttaaatagctaaatcccaggcatttaaaaaaaaatctgatttaggagaattcaatttgtgcctttatttttccaataacacagctattgcacaaaaagaccatatttaaagtaatgagaagctactttttataatatgtatcagataagaagagagaaagtgggtgacatcaacacttactgattgcctgcagtgtgcctggagctgcagacacattatttcatttccctctaaaatacaactatgaggatggtatcacagcctccattcaggatctaaggaacctgaaaacagaaagattatatgactgtgtctaaagtctcaggcaagaattcaaatgcaggactgccattatgttccttcccttactccatgccccatgggggcaggaggccatgctggatctcaaactaaccctgatttgataatgaggactgggagtgagatgttctagagtcctaggagacactgattctagtcttacttcccccagtactcactgtatagcactgggcaagtcacttaaccagatctcagtttcttggtttctaaaatggggaatgattttcccccatctcccagtttgtgaaatccaacaatataatgtgtgtcaaagtactttataaactgccaagtgctataagaatgcacagggatactattagtctaacaatctgtcctagaactaaaatatgttactggtgtattgtacttagaagatctaagaaaaccactttctcatcacgcttgggtctagtcagaccttaacaacggtcacaggtccaaaaaaagtcaaccctggcaagcctatatggagagcacagagcttgaaggaaaactggaaaggacgcaagaagaagtcaatggaactaccatgcctgacctggaaaactaaaggtcatggacactgagcatctaaatcgctattctgaagaaagtggtgacaagataatctcctgttgtgaaaacaagacaaccggaaaccttcctaagttgtaggtacaatataatgcttctaccgctgggtcatgaccactggaaaagtcagccaataaatagccagcagctttctagctttaggcataaccctgcctggaaaagtatgaaattggcaacacatgtgtccaacaatctatactcctctgagggctctcctagatattcctacttctgttcacctcctgccctgccctgccctgcgctgacctccccagaactaggtctcttccttccctcagtgcctttgttctttcattaccttggccctccccagggagtgagtggattcattagcaggtatcaaagcctgaagatgcattactgtcatccccaaatggaacatctgcattctcaaaatgattcctaggagagccataatttatttaccaaagaaatatcaccattaataatggttaaggctagcaatgcaacaagccagagcagagagctaggagtcaggagcgtctcaacagtacctctcaaatcattccaacagcattgcccaccactgagaaagggtgtcctgggatgagacaatattatgctcagcgtccctcccagtgagtgggtgagtttgtcgcaatttgtcaaattaccaagtagaaatgaaaatcaaagaaaaaagagagaaagcccaaatctaaattccaattcctagcagaaagaaaaccctctcttgaaatggaaacaataagccagccaactctcagctcatagcctctcctgggaacaacatgaagtggccgtccctattgaatgaaccacatttgtgagtctggggatgcccagtcagagtctatcaagaaaacagcaagtttcctgaacctccgcaagccagccaacttgacagacatggagatgtggccaggtcttggctgtgggtccaggaagagagaaattcaagcagcatcttcttttaagacactgggacagagcaactccactccccccaactaaagcaaggtcatctttatgatgggcattctaactacctgagaaaggtggtaggaaggaaacttggaaggaaaaaaacatgtgtgtagtgtgctgtacatcgtgccctgaagacaatggaacattcatacacaaagattggcacgcaattgccaatgtgaatgtcagacgggttatttgctgcataaataccaattaaacaagccccgcagcagcttcaacctgctcagccaactttgaaaagagcacatctctccagacctctaactttctcctgcactcactggagctcagctcttccttttctctattccttttggatgtagatgtttttagaattattcaagcagccataactttcgaacggtgcataacagggcagaactagctagcacaatccaaacagaacaaattgagcctaaggaacagtatacagctgtgttctcagtatcttcttctttattccgggtcaattgtctcctacaaagcctcccgtcatctatttctccccacatcccttattcaaaagcaagaattctctatcttagacatggtacaacctgtagttgactctaaaatggaaaaattgcattttaaaaaaccttggttcattttccctgacggaggaagcttttcttttcaaaattatcaagccacacgttttcaagaaccagagaatgaattgcacacagctgattctgcctcctacagagatctttcacggtattattcacaagcaagtgaccaaggtaaactaaagtggtttctgtagccatttgcaattattgacaaacaatttcataacggaaagtggaaattacaggcaagtgcaataagctgtttatccacgatctacctgctggtggctctttttctctatttttctttcaagcaaaatacaagctaccataggaatgcttttctcccgttcatgatttttcttgtatctccaccaccaaccctgttttccagttctgtcagttggcaggatttgtattcaatcgcggtagtagcccagactctagtgtattcttgggtgttccagagactcccgcaccttcaggtttgtgggaaaggatcccccaaatggcaaataaggcactccctcccggggtgggacttgcttaggggacttaagggtttctgcaaccggcgagggggtctgttttcacccccgctatcttgggtgcgcagacactctctgacaccaggcttcacagtttgggccacgggggaagtaattccccagggaaccgcgggggtgcggttttgcgcaactgggtgactcgcgtgtccctccgcatttcatttgcaccaagggagcgcgtgtcagacgaagggaatttttttttcttttttggtgattctgttattttttcaccaactgtacgaagctcaagggatatccgagctttctggctgggcggatgggcttcgcgcttggcatggctgagcggtccatctctacctctccgtttctatctctaccataacagcgaccactcagcccgccaggagcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttact

SEQ ID NO: 112 - DNA, 804919 bp, Homo sapiens; identical to SEQ ID NO: 110

SEQ ID NO: 113 - DNA, 2220383 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcattatatagttcaagagatttggtttgcttagaatagggtcatcgtcatcacaatccaattcaagacagataatctgcttccaccagtgagatacatgtacaatctgttcagaatcagctccttgtcaaaaacagaattttagataacagtctggttaaagatttattttgaatactatttcaaccagctttgcatgatcttttttctccctactttctttcacaatttggattacagaaattgtttgtacaattgggtttatgttactgctgaagtagaaaaaataataagtaatcctaatatagctgcaattaatcttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcatctaaaatgcaaaataaaaaaataaaagttaggaagcaactttaaatataattcatattttacaaccaaagtaactttccattatgatgtgttagtgtttttttacatttagtattacattcattgataaatggaattaaacatgagtgatgctggtttggggcatccaaattaaaattacttctgaaaaatggccaggcgcggtggctcacgcctgtgatcccaacagtttgggaggccagtgaggacggatcacttgaggccagtagtttgagaccagccaggccaacatggcgaaaccccatctctactgaaaatacaaaaattagccaggcatggtggcatgcacctgtaatcccagctacttgggaggctgaggcaggagaatcatttgaatccaggaggtggaggttgcagtgagccgagatcatggcactgcactccagcgtgggcgacagagcaagatcccgcctcagatttgtaatatctgaaaaacaattaatatgaccaaacccatagtcgttcaaatactgtatgattataaaaaaatagtctcctctgaataacagtatttattcgccagttatgaatagatactccagtataattaaaagaaactctcagctgtcatttactccgaaaaactatttcggagcctttccccatgccatccacccaaccatggagaaatgattattccttcctttgcagcatctacatactctaacatgggcctgatctcactatggaagaggtttcctgatgagcaggagcatggtttagttatctttgcttcccagaacttagcacactgtctgaacaaattaagagctcagaaaatacatctgacaaatacgtgcatgctttaaggaaggggagattctacaactctaaaatttctaggacctcttttcatctaaaagtcagaacatttcaaataaaaatgcaaatgatactcttcatgccttacatataaatactcaaagaaaaaagtccccaaagatttatactaagggattagggagaaaaattattaaaaaacagcttcactgaattcatgcttctacaaatgatctttttgcccctaaactggaaattagtattaagtcaaatggacagaaaaatcatcaatcttgatatattaaaatgtttttctccaagcaaaagactatttttttaattattgtaaatataatcatattagttaatgttcagtaaatgaatgcatctgagagatatttaaaattgataaattttatattttatctacttggattaaaagaaccgttattaaaatgccctttacaaagtaatcatatttgctctcatatatttttcagtagtaaatctccgttgcttctcttaaaaacataaggaatcactttcgcataacaaatatatgcatgcaccaaaaatatctgtttatctttaaatcacaatactaatctataagtagattcctttagtcaatatgagaaataacagtgaataaataaatttcaaactgtcatcttaggtgagaaattttatttagcattacaaaatacatttttcttatttaattatgttattcacacaagcttctatatgtatgttcaatatcaacattattcatatggtatatgataaatcttagctacaatatggaagtatttcctttgttgacaagggtgaataaataaaaacagatagtaatagttttcaaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagcattttgcaaacactcccctctcacagcaatggtttcttccctcaccggctcaatctacctgattacgttcccttctaatcagtaacctcagttcctctagaaataactgtgtcgtctgctttatataggatttatctgagtctgaagcagaaactggaaagtagacttagaggagctgattattatgaagacacctgtatttttgtctggtattcacgtgaactcgacagtgcactcatttatgcaaactggtgttagtgaaaaagaaaaagaagcagagaaggaagcaaaaagaagagactggacctataaagttgcgcacctgtgtgatgctaggagaagaaaataactctaaaaacgtccagtgctgctgaaaacacatttgaacttcctatgaaaaccaacagtgcttgacatacaaatatcttcctccagacacacctttaaaaatacattttaaaatctgaaacaatcttaaactcaatctaaaccacaatgcagaagttaattcttaaggcaaatggagattaagaacgaaacttcatccacataaaccctgtgttttaaaaaaagaattaaaaggaataatccgtataacttactcaaatttgtatttgaagttaaaccttgaatcctgcttcttgaaaaaacagaattgtgtcaggcttctgtaatgactgtttacccagagcataagattgaagtggattttcagattaaaaataaaactcttaagtatgtcaatccccatctgatcaaagcatataaactaaatttttccaaggacttcattaacaatataaccaagtagagctgcagttcttggttttctttagagtaagttgttaaaatgattgaagttcatgtaaaagaaatccagagttacagttaaggtttgctttttttttttttttttttttttttttttttagtagatccagtgcccggcaaacagtatgtgctcaacatatgtttatttaatgcgaccaaaagcatacaatataaagtgtcattatcattgccactgatatttttaaaaagccatgttctatacttatttcatttttacgtaagccacaattttacaaggtttcaaacaaaaaaaaaaacccacaccttgttttctttaatataaaatatttggcaattataagcatggaccgtgctggcagtaagttaaaatgtgactgattttttttttctccgttccctactctcaattttcagatgcggaaatttcatttggagagaacaggaggtgttggtgggaaaaatctcattaatcgtaccgtattcccttgtctacaaagagtactgcatccaaattacagaagaactaaagaaaccttgtagcatgagtataattagcagtgctactaagtgaatggaaatggaggttgcctaacttaattaactgtaatcattactcattgtcgtactgcttagaaagattagttgagggtatttcttctgtggtattactttaggcgtttctccttccctcttaaatgtgaaacaattacactataaagaaagaattagcatgccctttcaatcagatagaagcttttccgaacaagtaagttccatgtcctagctcgagggcggcaaaacaggaatgatgggaaaatatttagttgggccaaagttagagaaattaagaaaaaagtagttaattgcagaagttactgacttgaggaggaaaaaaggaaccctatatatgagtttctgtaaagaaattagctcttggccagggaagaaataaataacaaattaagatctaaagggaaaaattaaggataacacagtacaaatacgcagtactgtctgatgaagttgttcacaattgcacaacagtgcaagattccacaatgcaccttcaaggacactgtagctaaggattgctttctgatcatttatccttttagcggaagacacttggcatctgggaacatttgttcttttgaataaaaatcacctcatacctaaaaggaacctttataaatatcagaaaaacaggaatgtctgtgacgacgatcattggtggggcttggcctcattagctctggggccactagtgtaaaaaaaggttcacagggactctcttctagtagggactatatatatatataaatatatatatatatgacggagttttgctcttgttgcccaggttggagtgcaatggcgtgatctcggctcaccgcaacctctgcctcccgggttcaagcgattctcctgcctcagcctccggagcagctgggactaccatgcgccaccacgcccagctaattttgtatttttagtagagacggggtttctccatgttggtcaggctggtctcggactcccgacctcaggtgatccgcctgcctcggcctcccaaagtgctgggattacaggcgtgagccacagcgcctggccgggacttcatatttaatgaggcttttcactgttctaggaattaaactgagtttcaggtattgcattcaagaatcttctcagcaaacctgcaatattggtaatgttattccttaaactcgttttacaggtgaggagattggagctcagagaggtttttcagtcatccaactaaccggaagtgcttaagaatccagctctacctgactccctaaacaagtgtgtgtcaagagttaatgggcatacaaaccacctgggtatcttggtaaaatacgggttctgattcggtaattttaggtgggacctgagattctgcatttccaataagttccctggggctgctgcggctgctgctgctgctggtggtctttggacaacacatcgggtagcgaggcccctagacccgtggttctccaactttgctgatattagaatcccctgaagaacttctttaagaaaaaaacccagtgcccaaactgcacttcatatcaatgaaatcagagtctctagaaatgagactcaagcaattctaatgaacagccaagtttgagaatctgtacccattgacatgttgttatcaaattaggtgctcatcagaatcaactgacgagctcattataaacccagagacctacattcattaaagcagtgataagacttaggcctttgcacatttaggtagaccccccaggtgattctgttatccaacagtttgagaaccactttctagaccatgctccttcaaatcaatcagaccaagccctgcagacaaacttaccattcaggcaaaaaaagttgtgagtaggagcttgttttcatgcatatcctcagggttcatcggtacgataagatatcctccaagctaaaaattcatggggccctcacaccaccacatccccagttacagacatttttttaaacctcttttgtgagtatcagtgtactcattgtatgcttacactgtgtgtgggtttttatgcctgtggttgcgcattaaatctattactttgtcagtacttcaggggaaagcgtatcaatgttgtaagacatttaatatatgcccagggtagctgtataattaaaaggaattgattttgaaaaagaacctaatggtaacctgaaatgaatagacaaaatgatccctaagctcagtaacaactgcagcacaatgtatcaccttaggttaaaacctagttcataaataatcctcaactcctcttcaagggcttgtgaagatgagggtcattttgagaagtgacacattttggcttcaggggagttttagcataactgctgtcagattatatcttcttaaacattttcgttggcagtgaagggaagatgttagatcatgttagaaatgtaactaatggggtcaaaattttacttccttacagctcttaagagcacatacttataggaaactcttttggatatctcccttaatattatctagaattgtccaactattcctttaaatgagcacaactggggccactccttatggctctgggcattgcaccttgcacaaaggtgcttgagtatcatacccacattccccccagccatccctgtgatcctccaataaagcagagtcatactgaaaaaaaagcgtgctttctttcaaaattggctattctgtggatttgggaagtggggaggatgcctctttgtttaattttcaaagagtaccatataagcgggtagcagtcctgcggacaacaaagtgtaataaaaaatgtttgggatttcagttggaaggcattgggaactaattttatgacctagggcaaggtatttaaacttttagcatcaccaggctttccagctataaaatagcttggcaacatgccatagacaatcaacactcaggctccgaagtcaaagcaatttaactagggcttgaattccagttctcctatgtactagctgcataatcttggcacgttatgttatttatatcacatttcgttgtctgtaaaatggggataatatcaattccagcctcctgaggctattgttagtttccactacaaggtgtttaccacagttccagatacagagttagtgctaaataaatagtagctactatttatcaacaacaataataagatgataatcactcacatttcccaaggctttggaggaaattaaatcaaatgatgcatacaaaataagcctttgaagtgaaaaacaccataatgttgttgaagatgggttttcttccttttagtaatatgtttgccatatctttgattttaaagaaatagtagtggttaaaaaaaaagcaagtagtagggccaccaaagatctggctacaataattgttctgagaggttaggctcctgctgagagttggagctaaacctagcacctatatgtagtagtacaaacctaaatatacagtacatcagggaacaacgtagacttcgaatgtacagatttaaaactagaactgcaataacctggtgacatactgaataaattggaagtaagtccattaaatcttgtctctagagttattattcccaataatcacaattttttaaaatgaccatcttgaaaatcatgtttcctggagtcacctccaaatagcagtaagctacccatctcctattacaaaaagaaaaatgagaccagcttgtaaacacattacccaataaagtaccttacagtgcaagcagggaggcattattgctcaatggaagtcaatttaaaataagaggttaccgagctttctcaataagagtaaaggatcccggccataattgttctgcagtaactttggaaaggtgtacttttattcaaaccgtgctatgattttggcttctctcctagggaggaactttcatttcagtaactaagttcatgaaaagccaaactctttgcagctcttcagctggcagcattttttccagtttctacaatctcatcactgtggtgtgtgtctgtttacttaacgattttaagcacaattcttcatgacccatttatttttggatactgttcttttattttgattgcatatctttcccatagggttacagcaagtttgaaggaaaatcaaacaataaaacactcactcaatatcataggggtatttgctttcaaaagtcaaacagaatgaaaatctatctggttggttattttagatgattagtgttaatttttgcacctgatgaccaaaaatcattttagaatttgatataaggaacttttgcacagacatcttacaacatggaatatctctaagtgttaagttttacataaacatgaacatctggaagaacttgagccaacttgggagctattattttacccagcctccttcatcaaacagagctcagaactcccctccgttagctttaagcttttctcaatgaactgagtaatggaatcttgagggacacctttaaatccagcagtagaagcaaaaaccttccccactgataagcaaaagaatatttctggcaacaaaacccatcaactataggcggtatatatctaactcagtcagccttgagttaaacgtgagtcagtaacccctgaaggcaacaacaaaggcttagagtgaaataaaaaagttcgcagacatactgcagaagatccagtctcagagaatgatctgcttaacacttggccctgagattatctgagaatttcctaaaacattcaacacctcacagtgaccacagttaaaaataatgtattataggtttcaaaattgctaaaagaatagattttttaatgttctcgctacaaaaaatgataagttggtgaggtgatagatatgttagtcagctcgactgactctttctacaacatacacatagatcaaaaacatcacgttgtactcggtaaatatgtacaactattatttgtcagttaaaaataaattaattaatttttaaaaaacttcaatacttccaagatctgggaacaactacgtggtaagcccattaatttataactgggactgtaaaccaacagaacgaattcttccacttaaaatcagcctttgattaatggcatacccatatattacgtctcctatatgagaacaacatataatgtatggtatttattatcacaaaatttctagaaataaaataagtccagttcagtaggtataatcctgttctaaatccccatatgtctataatgctgccacatatatcttcttaaaacactagtttcttcatatcacctactgtcattcttataaccccaactcttgataagatagtttccatccattgtccaaacttcatcatctgcctttcatttctcagtacactaagcttgcttctactgaaacgcactattctacaggtttctctctccattagattataagatatttaagaacagaaagactggcttttttacagctttccagtccctagtgcttcctagcactgttcctggaacatagttaccacaaagcaaacatctacttcatgtttcacattgatatataccccactaacgtccaacacgtgttatttaaacaaatactagtctctaaatacttgtacatctgctcaaaaattttataaaatatgctagatcatttctattgtgaaaaattagaagcaaactaaatattcatgaaatagaaatgaaaacaattctggtacatcctattaatatatttatatgcagacataaaaaaatcacattcttatggaatatttaactacgttggaaaaccatatgatatattaagtgaattaagcagcttccaaaactatgtgtatgctaaaatactaaaatgtattattcttagtggttaaaaacctaggctctggagcctgaatgcctggtttagaattccggctccattttataatggcattgtgaccctgaacaagttaatgcatcttgttattgcaccaattttcacatttttaaaatggtctaataacagtacttatattataaaattattttcaggcataaatggataatatttaacatataaggtaattgaaacatgggtatgtaccaagtgctagtaaatattagctatcattatatagttctcaataggaatgtctgtgccaaacaggtaacactggttattcctgaatagcaaaattataggcaactattacctttattgtgtttttctgtattctacttttggcagtgagtgtatattattttgtattataaaaaatcaggctgggtttggtggctcatgcctgtaatcccagcactttggaaggccaaggccagaggggtggttgagcccagaagttcaagaccagcctgagcaacgtagtgagaccttgtctctacaaataatttcttttttaaatcagccaggcgtggtggcacgcacctgtggtctgggagggcaaggctgcagtgagctgtgattaagccaatgcacttcagcctgggtggcagagtgagaccccgtctcaaaaaaaaaaaaaaaaaaaaaaaaaaaaccacaacagattcctcttaaaatatgcaaaatatttactgaacattacattggtaagatgcatacattgttaatggaacaatgctgggatactagatcgaagaagtattgtcatcacgagtagcaagctgcctgtaaaatagtagacattgctctctaaaaatgctgtatttcattagtgctatgggttgaatatttgtgtccctccaaaattcatatgtagaaacataatccccaatgccacagtattaagaggtagggttttaagaaggtgattaggtcatataagcggagccctcatgaatgggattagtgcccttataaaagaggccaagggaacttgtttgcccttccagtatgtgagggtaaaggaagaaggcaccatctgtgaagcagacagaaccctcaccagacaccaaatctgccaacattttgatcttggatttcctgggctgcagaaacagttctgcagcaataaatcttcgttgtttataaattacacagtctatgatatttttattatagcagcccaattgaactaagacaattaggagtaagaagtacgaagaattaccatcattatatatgatgaggttaaaaattatagaaaagatatttctacagaagaatttttaagtggtacaagtttaatacatatataaatatacaagtttagtatatattttatatattcaagtttaaaaactatatacatatatattaaaatttatcacataaaaatacctctctagaaatatcctttctataatttttaacctcatcatttattggaatttgttatggagggagatcgtcccctgctcccttaaagtttatagaaataggtcaatgccatctttcggggctctcccaagactattacaataaaacggggtgtagcaagataaataaaacacacttaggcaaggtgtgctaggatttccaaccactttaacttggcatgaggactattagtctaacagaatgagatactgagaacacatcatcagaagcacttaagcataaatgttctctttttatagtggtggggggaggataacgggagaaatgagtaaaaatgtggtttcagcttctagtttcactaggaacggacaaattagaaagtgaaatgtgagacaatagaaagtttgatgtaattcagcagcactgcaaccatcaattattattttaacatttttggtaaagcttccttttacatccaagaggaccaagtgaaatcaccatgttcttatatttacccatagcatttcttttttatttttatgagctccttcttttgctgaatgaataactatttcagcacactaaaaaattgtgccttagatgtctttctaacagtgcctgtatatggtaagtgctcaataattgcttgataaataatatgcattctgcagttgaggcaaaaaagaaatgacccttttttggaatgaaccaagagagacagaactgaaaaagtgaggaagaagggaaaaataatgaaggaacagaagatgatgtcagataggacttttatcaatgtaagtaaatataattcctatatattaatgaatgtgatatgttacattcatattaaaagtttattaacaaaacatcaccacaatgaatatagttgagattttccttgctatgtgataggtactggtctaagtgatttttatttgttaattttctcatctcagcaatcctatgaggtaggtgctattattaactctatttttcagatgaagaaactaaggaaaaaagagagtcagtgtataaaaaagacagtacaaaaaaagtgtataaaaagagagtcctacagtacagtactgagagaaaatgaaagagttggatttccaacccagaaagtttggctttgagtctgtccttttaaccaaaatattcttaaacatctgtctatattgtctccatttatatatacattaactgaatatttttttaatgtcccttgagttagagaaataatactattacctattcgacaggaagaaacatcagacagaaatgacgtggcctgatcactcagctattatattggcagcaaagcctttctctggcattacttaattcgtattctcacagtaacagcattctcctatccctaattctcagtgctttaggctatttcccaggaacatgctatatagctggaaagagatataagtacaatttgccagcattaataatagggatattgctccttgcatttgctacttctttctgtatctgtctacttttattttttttcttattccctaaacactctatctccattgtgctgattttttgaagatattcatctatcttgattttccttactttttattttctttttgccttggagtagtgtttccttttcttttcatcctggaatagattattgtcatttcaaggcctcccttgtgagtacttttttctcctttttattgccattcttcagcatttttactggtacttataacagttctccttttcttgctggcttctggcgtgggtttgttgctatttcttgttctttgatgtttcgcatatctgattgttccctttctcacccctgctttctgccacgtttacctctttgctattatttgtttcctattttgaaggttgacaactaaggggacagtatcattccttaatgtgtttctccagcttactcatgaaatcagcagcagcctccttcacacataaaaccagtccgggagggcaaagtgactcacgtctgtaatcccagcactccgagaggccgagatgggcggatcacttaaggccaggagtttgagaccaaagcaggcaacataaggagaccccatttctacaaaaatgagccagatgtggtggcgcaactgtagtcctagctactggggaagctgaggtgggaggatcgccggaatacaggagttccaggctgcagtgagttacgatggtgccactgaagcctgggagacagagcgagacccctgatatagtttgaatatttgtccctgccataatctcatattgaaatgtaatccccaatgtttgtttgtttgtttttgagacggaatttcactcttgtcacccaggctggagtgcagtggaacgatctcagctcactgcaacgtctgtctcccaagtagctgagattacaggcacctgccatcacgcccggttaagttattcccagtgttgaaggtggggcctggtgggaggtgatcggagcatgcgggtggatttctcacgagtggtttatcatcatcccattggtgctgtcttcagatggtgagtgtattctcatgagatacggttgcttaaaagtgtttgacacctcccactctctctctcatgttcctgccctggccacatgacatgcttgctcccccttcatttccaccatgattttgagcttcctgaggctttcccagaagccgagaagatgccagcattatgcttcctgtacagcctatggaactttgagccaattactcttttctttaaaaattacctcatcttgcgtatttctttatggcagtgtgagaattgactaatacagccccatcgctaaaaaaaaaaaaaaaaaaaaaaaaaaaatgtctaatcaaagttggaaagtgaacattagggaaatacatattttgtataaataaatcctttggactcccagcttcttcctttgccgatcagctttaagggacagtggttctgtttgacttttgaaaggacagaacaagatccttatatatcacatttctgctatcaatagttaagagtttttgctataaattgaaagtatcatggacacattctttagtcagcagtcactccctgtcattaattaggtgttggaatgatgttctgaaatgctgtttaatttctatgaatttcaagtgggattgcccagcaagtacattgccagcatatgtagtaagtaggtaattttcttttaagattatgaatgttattctcaaaattttaggttgtttttataagggacagtgtacagtttgggcttttgtgttaattggaggttgacaagggaaaaagggatagttttccagcatgctttctaggtttttctaaatagtacaaagatgttcaggaggaagaaaatattgctattttaaatggaatattttcaacgctaacttaagcatatctcagtatttaagcagacatttggatattttcctcatctcagacaataactactatgaccttgaacaaatccctccattttctgattctcagttttctcatctataaaatatgggaattggactaaataactttgtttccatttagctttagcactctatgacttttatccatttacttacacaacactactcctgagaaacatacatttatgcaattatagggataaacacccaggacttcatttaatagattttccttataccaccactgtactgtactggtaacagacactttcccctgtataagtaagctatcctgcagatgctaatggggtgaccccaaaaggccaacagaaattaaagaaacttggcaaaaataaacaaacaaaaaactagccgtggcatacagattaagtatatttacaccaagttatgatttttttagtgacttccccatttaaagttactgatatatacgtgtgtgtatatatatacaatatacaaaatcatcagtatattttcccctagataataattgttaagtataattcaataattgttacatgctgtatacattttaagtgatataaatctttccaacaaacctaaaatgtaagtagttcttttcctaatttccaaaattaagagaggcagagttaagcaacttgcctaaggtcacagtcattaaatagcagcactgagattcgaactcagcaaacagcctggctccagaacccatgcgtctgataactgcttcttataatatggttgtgttcatccattttcttgttcatctattgtgaggttgccagcgtgatttcttcaaaggcctgctggagtcaggaatatgtccctaggtcacagagctcagcaaattttagtagcctaaaacttgactcaattctcctgagcggtactctcagtgtgacctcgctactggtcaaaagttgtaaacgagcagttacatattttttgctgctctcaccaatacatgtcttgctatgtatggccaaacgggttgacttgtgcactcaaaatgcaaaaaagtactataaatatagagtagaaatggaaattggcgacataatatgacaatttaaaaatttaaaatatctgattttcacaagtcttaagagcctcagtgatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaagttagagaacgaacaagaatgttttctagatattaaagtaaattcatttataattatgccatattcagatggatgccattcctatatattaaatgttcatgattttaaaggtcattggacaaaaacactatgaataataaaaaattagaaaaaatgtgaaaaataatgaatggaattatagtagaatctattttaatggatctccatttaactgaatcattagattaaccaaagctctccattccctttgttagatttactatggatcaagatgacctgctgaaaaaccttaactagaaatctctctatgagagataaatcgtatgctttggcggattaaagatagctgcgaatttttttgacatttcttcactggggaggtaaagtctttgtttcctcccttgaatttgggtgggttctgtggctgctctaatagaatgcagtagaatagtggtccccagcctttttggcaccagagactggggtttgatggatgacaattttcccacagactggggttagtgggggggaggtgagggatagtgttaagataattggagactatttcatttatcatgcactttatttctattattattattacattgtattatataataaaataattatgtaactcaccatatcatagaatcagtgggagccctgagctttctttcctgcaactagacggtcccatctgggcatgacgggagacagtgacacatcatcagtcactagattgcctgatactcctcataaagagtatgcgacctagatctctcacatgtgcagttcacaatagggttgtgctcctgagactctaaagccattgctgatctgacaggaggcagggttcaggcagtaatgccagcaatgggaagtggctgtaaatacagatgaagcttcactggctcaccgctcgcctcctgctgtgcagctgggttcctcacaggccacagatgggtaccggtgtgtggcccaggggttggggacccctgcagtgaaagagctgctgttctagtttccagggttaggcctgaagataccagaaacttatattttccgtcttttgtatcattcactctagaaccctgagctcccatgtgataagttcaacaatcctgggtctaccatgctgaagaggccacatgtaggtactagagtcaatagatctagttgacccaagtctccctgtcgtctccaccaaagcaacatacatatgagtacagctgtcttggattctgctgaccagctcatctgccagctgagtatcatttagggatcaagttgataccacatagagtggaaaatcacccagttgacccacgctcaaatttatgacccacaaaatcatgagctataaaaagtgactggtgttttaagctattaagttttataataaattgttactcagcaatagataaccggaacatagcaagaatcaactgtgattgttcccattcctgctcatgtaatgatctaatataattatatactacataatttgatgatacatgactataaaataaagagatgcgttctttctaaaaaatacaaattatcagtaaaaattagctgaagaataaacaggcctttgggagagggatattagaaaagtattgaaggaatcccctcttaaattgttttgcaaatgtctctgtgttctttctctactgcacagaaacgaaaacgtacaagtctctaatctgtaccaccaaatcctcttgattttatgatctcttactactttcttccttataaaagtcagtcttttttttttttttttttttgagagggagtctcactctgttgcccaggctggagtgcagtggcgtgatctcggctcactgcaacctctgccttcagtttcaagggattctcctgcctcagcctcctgagtagctgggattacagatgtgcaccaccacgcccggctaatctttgtatgtttagtagagttggggtttcgccatactggccaggttggtctcgaactcctgacctcaagtgatccgcccgcctcggcctcccaaaaatgctgggattacaggtgggagccactgcgcctggccagtagtcacagtcttaattgctattccttgaacacactctcacctgagagccttttttccactcattcccttaacctggaacaatcttctctatctagttggcttcttgtctcgttctgatttaacctgctcagtgcaactcatcataacacattatttcatgctcttttccaggccctagtattcctgatttcccttgccctactacttttattttccttagcacttatatttcactaacacacaacataacttattaacctaccaaattactgtcctgattgtgggaaatcagagggcttttaccctgaagcaaaccacaacagagaaatagactattttgaagcaaaggtttaggagatcacatatagctgtgaacaaaatatcaacattttaaaactatataccagactattaagaagaactcaaggttttcaacaagggcagtgataaggagaggtcagcatgctttgctatgttatgctgccctctggcatggagttcaaataggccaagataaagccctgttcatgtatttttgaatggataaacaaagtccctctagatgagtacagcgtttgatttttaactacactatttcaggtaacccaaagcttttcttgtctgaaacatataagttatgacaggtctctggaacaagttatatctaaatgccagagtcaggtagtataaggcaaaaagtatacaatccatttttacttgtgtcaccaaacatctcttacattttagctgctgacttttcactaatgtattaatacagaatattatttctgcttttcttcaatttaactaaagaactgaatacttacatttagtatcaaatttctataatgtgtcttcttttaaaaatacaaaggtaattgaaaatatcaattaaatctgaatagtgactagattttatttagatatgagagatacataaatactatggatacaaatcatggtctctgccttcaggcagctgatggccctgtgaacttgtatgtgaagcctgtctggggtcaaattctagctctgccacttacttgtagtcttaggtaagttactcaattttttctgatctccaatttcattgcctataaaagagaattggtgtatatgccaatcatacctcaataaagcagtttaaaaaactgaagaatcaattatttctgaagaaaaaaaagaattggtaagaactcctttatagtgtgtgataattaaataacaaaaactagaacaaagtggcaggcatgggacatggtccatattcagagctaaaagttttctctcactatttttattttcctaaaatgaactagtatttctagaagatacaatgagaataaaaccaattgaaaatattttcttttaataacagtgctttaaaattagcaaaaaaattaaaatagaattttgaaaaaagtaatcaaatagatttgctgtactactgactgtatgttctttacatttgtatgttttgtttttatattttggtatttttaagtattattagtaggtgttcttaaacatttaggtaagatattgtatagttattagctttactattattattattattattattattattagatagagtctccctctgtcgcccaggatggagtgcagtggcccaatcttggctcactgcaacctctgcctcccaggttcaagtgattctcctgcctcagcctcccaggtagctgggattacagggacccaccaccaagactggctaatttttttttgtatttttagtagagaaggggtttcaccttgttggccaggctggtcttgaacccttcacctgaggtaatctgcctgccttggcctcccaaaatgctgggattacaagtgtgagccactgtacctggccagctttcctatttttctaatgagaaaatagtagcttgttgagagccacacacggagtttgtgatttttttttttcttcaggatacgttgcatttatattgtatatcagcgtgtattaaagtgtgtggaagccctctggagatttttacatgtggaatatactagttacttagtaattctctgtaggcaagcggctaagttcacgtatggaaaaccattaagacccattgctgtaacacagacaagggtattactgttaagtgtattgccattttatggtcattccaaacgagaaaagctgcttcattccaggaatcatattgctattataattcaccagaaaacctacactttcttttcctccaatagacagtcacttaaagcaaatgtacaaaaaaaatacaatggaatatggtttaggaattaatgaaaatttaaaaagcagcaatcccattgagaagacagaaggcaatacattttaaaaactgagcattatgcaagggaaaatttgagcagttttcaagttagttctgtattgttctcattaacaaatgtagatggtgcagcatttactacagacaattgattcagacttaaacttttgggctacaaatcatttatatttcagagaaaaaatatgtggtcaaaaacaactaggcagggggcgttggctcacgcctgtaatcccagaactttgggaggccgaggcaggcggatcacctaaggttgggagtttaagaccagcctgaccaacatggagaaaccccgtttctattaaaaatacaaagttagccgggcatggtagtgcattgcctataatcccagctacttgggaggctgaggcaggagaatcacttgaacccaggaggtggaggttgcggagagccgagatcgtgccattgcactccagcctgggcaacaagagtgaaactcggtctcaaaacaaacaaacaaacaaaacaaaacaaaactgtatttcccacaagagacattaaactatttttgtttttatttactaccttaatgttacgcaatttttcaaaagaaaatataatactgtagacgtaaaaaatttaaaacgtatgaaaactgggatatatcaattatcttaaagaagatattcctgaaacatacttaagatttaatattgaaatatataattgtttaaaaatacattaaatattgtttaaagaaattctgttaaaagctgtggggcacattatgaaggcaatactcacttctttacctttgttataaaattaattttgtccatcaatttttcatcaatcaaggtttatctatacacttgaaaattcaaatccacagggatcttgaaaagatagcatagatagtatctttctcttttaatagatgaaaaacaactgcagaaaggcacagacatcttcagtactaaataagtcatacgatacaatatgtctaattgatataaagaaaaggtaatcttgccatactgctccttctggctagtttatttctaaagctatatccaagaatcttgctaaaaatatcagctgtgttattttcattcaatctatttctttcaaacattctatttttcaaaattaggtttcatttgagcatcagtaactttagaagaaaaaataatacttaaaaaggccctggccaggcacggtggctcatgcctgtaatcccagcactttgggaggccgaggcaggcagatcatttgaggtcaggagatggagaccagcctgatcaacacagtgaaaccctgtctctactaaaaatacaaaaattagccaggcgtggtggtgggcgcctgtaatcccagctacttaggaggctgaggcaggagaattgcttgagcccaggaggcggaagttgcagtgagcagagactgcaccattgcactccagcctgggcagcaaaacgagcactaagaaaaaaattagtagtaatatgcaaagtcaggtctcagagctcctgtttcttctaaattaggtgtatctcctcagtctttgaatttagtctaaattggtttataaataataatcctgaatctttctagctccctgccacaaagatggatatttagatatactatggaatatttcactattcctgttttatttctagattaaaaatcaccaaaacaaggagacagaaattttatatcttccctgaccctaatttttccccttgaaatcttgctatcaattatactgacctttggttgtaggcatttctttatatttgtgtttttttgttgctttctacataaactctattcatggggtcttttgccaactcattatattatcctttcagaatatggtcaaaggcaagcccattttacaatccaattgtcatttctaagaggatattggaattactcatgtacagagtaaaaggttattttcctcacctcctacttagcaaaagaaagtgaaaacaatgacattcttatttttagtgatttaattacattttcttatccatgtgattttcttcatctaatttaacaaaattatcagagacatggtctgattacatatcatctttcttattccagaagtacaagacaaaactaaccttgatttctgcttataatcttacattctccccatggattcacacagctctaccctgatttgtggctaataacaacaattttaattttcctattcttttaatgaaagtaatattcctctcttcttctctgaaaaatgaatgcctttatgatttgggagggaaaaattctcctttggtgttttccttccccttcagttgacccacactattaataatcttcacaatatcaatcattgttgcagcttagacatagacaatgtttatgagcctttctctttttttttttttttagacagagtcttgctctgtcacccaggctggagtgcagtggctcaatctcagctcactgcaacctccgcctcccagattcaagcgattctcctgccttggcctcctgagtagctggaactacaggtgcccgccaccacacccagctaatttttgtatttttaatagagatggggtttcaccatgttggccaggctggtcttgaacccctgacctcaggtgatccacctgctttggcctcccaaagtgctgggattgcaggtttgaaccactgcacccagccagcatttcaaatccagatgctaccacaggaggctctgggccttaaagaaatgcagccagctagccgggcatggtggctcgtatctgtactcctagcattttggaaggccaaggtgggaagatcacttgaggcccagagtttgagaccagcctgggcaacacagggagatgccatctctacaaagaaaaaaaaaaaaattaaccaggcatgggctgaaacaggaggatcactttagcccaggagtttgaggcttcagtgagcagatcgcgccaccacgcttcagcccaagtgacagagcaagacctcatttctaaaaaataaataaatgaataagaaagaaatgcagccacttggaaccaatgctgtttttcagatctttgagcctctcagtaacattaattaagaaccctggtaaataaatatactaaccagtggcaagaataattgactgcaaatggctgaatgttttattattttcactttttttaaatagaagtttttgacaacataaaggccttacccaaaggaataacaataataatgaaaagagcaagcatccattgtgttcacaaaatcacagaatacatgtacatcaaatgaaaaataatcctttttcatctctgagaatactccaaaacttgtccatctgagtatcaatggaaaatcttgctctttattaaaaggaattcttcactaatgttcagaaaagctgaggaatgtacttacatcactaccgtcactactagagtatgcactggtggctaaaatgtcctaacaacttcttcagggctcaaatattttagggctttgaattcaaagatgtgtaaaatagagtctctgtcttcaaggactttataacttctatgcatatggtatgtgctagcgtggatgatggaagagttacatttaaccttcaccatggcaggaagatttattgggggagataaaactttgaagataagcaagagagccagattaaaaataaaacaaagtagaaggaggaaagaatgggtgtttcaagaaaaacaaatataatgtgctcttgctgatgggtaattctttgtgtattttcatactcctatttagtgtgtacctatttttctcacagtatatcgaaatacgctattatctgacttcctcgggtaagtctacaagaccaaatatacaataacaaatctattgagaagatacagttatttacatgcacagaaggttattgtgagaaactctatcaaatgcccttgctgatattggcctgacccacaattcaaacgtttgggtaccttcaagaaaatgtctgtattttttaatgtcctttgaaattattactctagtcatgcattatacgataaaagatacacgaaactgatgtccaatggaacagtaagctttgacagttcacattctttatagataataagatgtttaaattcatttccatgatgtattagtttcctgcggctgctgttaaaaagtactacaaactgggtagggtttgtagttgtttgtttgttttttaggagaaacatattgtctcccagttctggtggctagaagttcaaaatcaaagtattagcagggccatgctctcactgaatactctaggagagagtctgttccgtgcctctttcttagcttctggtattgccagcaatccttgccattctttggcttatagacacgtcactcgggatagcctctgtcatatgggattctccctgtgtgtcttctctgtatttcttctcttcttcttataaggacatcagccatgttagattaaaggcccaccccactccaatatgacatcatcttaactaattacatctgcaaagaccccatttgcaaacaaaaaccacatttttgaagttccagaaaagacatgaattttgagggtgcactatctaacccagtgcacgtgataacacaatcctcaatgaactgactgctgtcaatctctcagttttcaactccactactcaactactacatccaacttagcagacaaacaaatatatgtattgaatgagaaacagtccctagctggtaaaagtaaagtagggccaggagcggtggctcacgcctgtaatcccagcactttgggaggctgaggtgggtggatcacctgaggtcagggttggagaccacagccagggtaacatggcaaaaccccatctctactaaaaatacaaaaattagccaggcatggtggcacactcctgtaatcccagctaccctggaggctgaggcgggagaatcgcttaaacccaggaggtggaggttgcagtgagctgagatcgcaccattgcactccagcctgggagacaagagtgaaactccatctcaaaaaaagaaagtaaattagagagaagctaaagagtaaatcaggcaggattttctgggcagagaagtcatgcttggctataaagctatgaaagtacacagaaatcaaacatagctcatttagatcaggcataattattataataaaaagtcattatcttatggcctcacataatattattgcctatatatttctgtgttggtccttcataatacttggatttacatgcagaattgtatatttctgtatcatattttaagtgctctgtaatgcattaattatttgctagcctcatgtaggctgcagctctccagcctttaagttcagtcatatgccaacctgaagaacgtgagggattgagagagtgtcttaaatgagagaagcccatggtggccagcttcatcagaaacctagtgtggctctggttttcgccaggttctttgttccttgtgactcattctctgccttgcattgtctattcggtcccctcaggcctgtcctagctggaaagagctctctttacttcctgatcccatctgttccttgacctcccctctgacccaccactgggcatgctcagaataggaaattgtgccataatagataatcctgacactctgttccatttcttcatgttagttaattaccattcaaggtcttgaggcctacattaactgctcttaaatgtcaggtctatgtacctattgcctgttatggagcaggcctgttggtgaccaaagcagcataacctagcatctgttgctcagatatcatgtcccagcaccccaattaattgccctagccctagtctagccagtcttcagaactgaatcattatttatttggtctgtatgcaaaccaaaccccatttaaatcacattcatctacccaggactctcatttatcaatcaaactgacattttaaatgtcagatgagttatggtatatcctttgagtgatcatgataacattccctcatatttaggagataaactgtctgcatacatcaatatttttaaacaccgaagtaagtgtcaaaggtctgaaaattaatgatgaaatttatcacttcagtattctgcatgcttaaaagataggagtcacacctaccttccaataacctattataagagccaaaaatgatagctaacattcaaaactaggtatctatcatacaacaaatattttacaaatatgttctcatataatattcatatcactgttattttcccacttcatagacacgggcttagtgaaatttcataactttttcaacattacaatgaaaaatatctgagtttctttagtggctttgcctgttgcagacctcaattttttttttattatactttaaattctgggatacatgtgcagaacatgcaggtttgttacataggtatacacatgccatggtggcttgctgcacccatcaactcatcatctacattaggtatttctcctaatgctatccctcccatagcccctcacccaccaacaggccccagtgtgtgatgttctcctccctgtgtccatgtgttctcattgttcaactcccacttatgagtgagaacatgcggtgtttgttttcctgttcctgtgttagtctgatgagaatgatggtttccagcttcatccattttcctgcaaaggacacgaacacatcttttttaatgtctgtgtagtattccatggtgtatatgtgccacattttctttatccagtctatcactgatgggcatttgggttggttctaagtctttgctcttgggaatagtgctgcaataaacatacgtgtacatgtgtctttatagtagaatgatttataatcctttgagtatacacccagtaatgggattgctgggtcaaatggtatttctggttctagatccttgaggaattgcatacctcaatttttaaatacaatttaaaaatacaatcaattttttatctatatcacattcaggcctacctctaaagtatataatgacaatccccgatttacaatggttccacttacaattttttgactttgcaatggtatgaaatagtgcacattcagtagaaaccacacttcaagtatccatacaaccattctggttttcactttaagtacagtactgaataaaagatactcaacactttattataaaatagaatttgagttagataattttgcccaaatataggctaatctcagtgttctgagcatgattaaggtaggctagtctaagctatgatgtttggtagattaggtatattaaatgcattttccacttataatattttcaaattatggtgggtttattggaacataaccccactgtaagtcgagggatatcagcaacgcgtttaggaaaaatagaggcaaagtgtcctctagggtggactcagctaccagggccacagcctagtcagggacactgcctttatgtgaaggaaggctctacttcctcagggcagacacaatcccatgagtgtgtcttggatgcctttacaaagggctggatttcagtcctcacctgccttctcagccgagcatgcctgggcatgcaaaaatagcacaatggtacatggaacccttaaatacattccattaaaacaaatacataaatttggcagggcaaagttaagtttagaaatctattattcaaaagccagcaaggattctaaagtccttcagtgatcttagattgcgatcttttgaagaagacattaaatatgataccaatatctgacctcatttatcaagaggaaatgtgagtttctctcaaagggtgttgagtagatatcacgtgtttactatctctaacaaacagaactcatccagatgataatcttggtcttgcctgccggtgatgatctagtaaacttatagacacagcaattttttagcaaactttaagatagtataacaaaatttaaagacaaaactaaggatttttaaacctttaatcttatttaaattagaactctatcaatgaattaaatgtccaacctaggtgttaaaaattctctattactctaataatttctccccaaattttgtaacatattcgatattccagaactctttgcattgtaatagcattttgttgcatatgaaatacgtcacgtatctcattaaatactaaagcaaaacattaaaggaaaaattactgtcccaatcctacagatgaggaaattgagtctcagtatagttagatcatctttctaagggaaacacaagacttttgtctttatcaattagtcacatcatttatatcatttattgagcactgttctaagggtatcacaaatggcggctgctctttgaatcatcaacagtccaacaaggtgtaggtgctgttattttccccatgtttacagaagaggtagattgaggaacagagaggttaaataatgtgcccaaggtcaaatgctggtagagaataaaaccattttttatgtatgagtgcctatttcttacaaaactctttatatatattatgttcagtattttaggaaccagaaagggtgatattgttattcccattttattattgataaatctgaggttgagaaaggttaaacaacacaaccaaatttacgtgactaatgagtgacaaccaggaatcgagcccaccttttgctgtttctgaaacatgtattcttcccagaataacctttaatctctcaataacagctcatacaattcctccttcccatctcacaaaacctattctgagctctatgtctaccacgaataagcccaagagtagagagaatttatctcacaaggcttaccgtataccccttttcaataatttttatcacattatttctctttctcttccttagtcaacaacatttaatttactcctgaaactatccctacactaatctgaagttgttaaattactaagttattttgcattcatatttccaaaattaattgtccaagttcatctctcaaaatgaaataatttcagctagaaatgagctgtggcacagtaagcctttggatggggaaggtaattataattgttctgtaactctggttatggaacatgatctggacagtgagagttggatagagagggaagccactgggggtagtgtgactaagacactgttttagaatctgaggatatgagttcaagttccacagctaacacctgctagatttgtagtctgtaagttgtcaaatttcaaagaatcttatattcctcttggataagagataggtaataaaaactacctggcacagatggttttgtagaaaatccaataaaataactgtggaaactttgaaattttcaagtgccattaaaatatcaaataccaatttaataattagcttatgatcagatggttagggacgttgactgccgaagtgtatattcaaatcaatgcagtataggctttaaagtagggccaaagcatgaaatgcattttaataagtgtacacttctaggattctttgaaagttgaaaaaataattagtaagaaaatggagatgaagccctacactaggatgatagcacttagaaaaagataaaagtgaatagatgtgtcaaaagcagatttaatgggaattgacaaaaagggacgaatacttgaaactgactcaaagattttgagtctgagggattggaagagtcaggggactgctgttggaagagtgggagcaaatagaatcagaaaacacacgcacacaccaaaaataactggttttggatattttgagagccatagcccaaaagctaaaggctgttctatgttgaattatcaaagccactttctgatctctgtttttatgctgtttttttttttagcattttcaaatttttcctcacttaagattctgtaaaatttttattgcttatatgcttgtgtaagaaattcatatcatgtgattgtgctccaaaaatttttagtaggataatagcattttactgcttctgaaaatgacctgcaatattaggttattatttgttatattaggtctagaaacagcataaactattgactgaagtttgacattttaaaattctctaataaactggaggaaagtccacctctgctggaactctgcagtgcacagaaggcaaataatagactgctatcctgccatggcttcgcttaatacaaatttgtacaatatatacaatttaaaaatgaattcataacatttctattttctcataaaacattgtgatatgtcaggccagtaacaggtgtgaaaatgatggaatcaaatcctcacagaatacgtgtttagaacagacctcttcagtaaagacaacttttaaaaatacaggccgggcacgatggctcaagtctgtaatcccagcactttgcgaggccgaggcaggtggatcacccgagatcaggagttcgagaccagcctggccaacatggtgaaactccttcactactaaaaatacaaaattagccaggcatggtggcacacgactgtagtcccaggtacctgggaggctgaagcaggagaatcgctagaacccaggaggcggaggttgcagtgagccaagatcgtgccacggcactccagcctgggcaacagagtgagactccatctcaaaaatatatatgtgtgtatatatatatatatatatatatgtatatgtgtatatatctatatctatatatatctatatctatctctatctatctatctatctatctatctatctatctatctatataaagttttaggagaaatctgctcagaattgcattcctctcttactcatagtgataaggggacctcgtagctaaaaagtcttgtagaggaggttaaaagttcttcaaagtaaaaacattctcaactccagaaaacaacatgtaagtcaacccactcatgttttctaagccaatatcttagaaagttgttgtcgactcctcatgagcctctgctacccacagccaatctgttgctaaatgttgtgaattcttttttattgtattgtatgtcttaataacttttttcttcacttgccaaaataaaatccatatgctccccccaccctactgcatggttctccagtaaagactatagatattttttctgcttatttatatatattaaatagatttttaggcagtaatttgaaaatcactttgtctctttgaagttgcaaattgttatagaccaaggctggttcatgcccataaaggttgtttaattaatcgaatttgatatgacagagtattacacacaaaatagtggacggaatatgcacaaaacaagtttttcacaaaaggaagtgaaaagcttgtgccaaattcatctgtgtaacactagaaataaatattttaaaaatatatttattgcttagtttaaaaaactggccatttctgagctttaagctatcattggaagctttataatttaaggttttatttgcttgctaaatataattgagctgtttaattgtaatccttagccttggctccttagccaatgtagagcttaataaattcacctttagattatcaataataaacacacatggtaaaatctaatattgcaatagtccgtaaacttccgggcttactttctaaaagcagataagcagagttattgaagaagaatcgtgtgtctatatttcagaggcataaactcattttaggagtcattattactacactactttcacagcatacctttaatcaagtatcagaaataaagtagaacacatcagaaaataagtggtctgataaacaatttaccacacctgaaatgcagactttcatacgaaaaatgttctagcacaacagggtccacaggcaatcaacaatcctgttctcttccttctcctgggctgatctattagcatggctaatagatcattgcactctcctacagaggccagatgggacttctccacattttagttcaagaagatactaccaattaattagagttggcacttgaggttattatttgctttgctttacttactttctttctttttttttttttttgcatacagacttagacagctaaattaaaatcatattgaacatctccttcaatgtgatattaggacatttctagaagtgtttacttgaatctacagattttgagctataagggacttgagtttaggaatttagtttaaatttgactaatagcatacagttttctacctcagcctaataaactcactgactctaataacgaatttgaaaaacaacatgtccttagcatcctgacaaacccacagaactgctgctccttcctcctacatgtcagtttgggtttcagcattgcatgacaaaaatctcaattttctttatgtgttagaagttcataattggaagtgtgaataaaagttaggggaaaaatgacttaaacttcagcagcaggaaaagataatctttactgtctgtctagttttagagcatccaataaacaagaacatccatcaaaaaactctttggtggcttgaggaaatgtggggagtgcctgagtatcacgctatccttcttgtgaaatttttgataatacatgtctgtagtaagcatgattcacaactactaactaaacaatttataattccaacaatttcacctaaattacacaaaggtgtgtttagaatatacaggagaatagccagtatgaaaaaaaaatgtattcagagaaaagacaaataatacagctcaggaatgaaatgtttctcagctaagggacgacataggatcacaattcatctaggtgttttttccgcagttgctttcagtacatatttatacaaacagaataaaagaagtaccggaaccaaataagtagtaaacaaagggggaaagagatgattttgtaatttgcaatgctcatgcacagaaaataaaatgaaggtaataatagcacaaaaagaaaacaagggcatcaagtaagaagaggaagaaaaccaaaacacacaggacaagaagatggggcgttaaaacaagaaagctctagtggagcagtaactgagggtaaaggaagcgctcaagttttgatgtataggaagcaaagaaggtaactgaaagtgattaatgatgttgttttggcaacagaatagcagattaagggcagctttctgaactgattggaaaggatgctgaaggaaggaaaggtgctcagtgtgggaaatcggagatggcaggatacaggaataccaggtcaagagagatctcagtagtatattctaggttttaaaaatataatggagtgattgatatagtttgaatagtagtctaggtgttagaaagagacacagctcaacaatatcattatcaatcatcgctgagaaaaggcaaggagtaatttaacaggaatgataagcttacaggaaattaaaagtgaaataagatatatgagaagatgtgagaaagagattaacaggattattctttaaaacatggaagtaaatttgagaaacatttccctttccaaataataacccatactcctaaattaaaacttatggtgaaataatacagcataattttctacatacggatgaattcagtaaggagaaatacttaatttctaaaaattgaaagcgcaaagttattttgatttgtaaagttttcagatcattcctctattaaatatcagtgactttgcttactactttttcaggtattgtggggtatgtatccaaaaaagtgtgttacctgatttatgcatttatgtctattttttaaaacattgcttcttctataatttctcctcttttcagttcaaagaatggaatatagtacaaagaaccttgaacaaaaagtcatggctgggctttatttctgaatatacatacatacatatatatatatatattttttttcctcagtgtgtattcattgagtgaacctgaatgagcaatttaaactgtctaggctgccttttactagtctatcaaataaaagaattaatttctactcaaataaatctagaaggctattaatgggatattaacacatttaaaagtggtttaaagtagaaaaagcaccatcgatatgtatcactgatttgcttatccattccacaaattaagtacctactatggagcagatgctgtcttggttctgggacaacatctatgaatgacactgaaattgtccctgctctcctatcaggtattggtattattaaaaactgacgtatttctgagaagtcctgagaattctttctgtagtaggaaacaacgcttgaataatttctgctgaagaacatttaaaaacacagttatgaaagctggagagtaatccatattattgtccttgcttcagtttatttttctattattattttatgcattttaatgtaggtaaactaacttcgatttaggtctttctccttgcacaacttcagggaggactgttcatagaaaatataacttgaaaattgtgtccttgaatttatgcactaaatggtactgcttcaattcatattcttcaattcgactagtaattatttgaaagatttttaactttataatttgaaagaaattagacttatatgaaagttgtaaaaattgaatcacatattctaatgtatccttcacccagaatttttttttactttatcttaaatataatttctttttgtctgtattttagagtcaatttctactcagaagaacaagtatataatgaaaaactgttaaaatgtgtgtggcacagaaaaatgattttgagagtaaaatttgagcatggaaaagaagatgacttaattattatacttatattcaagcacaggggaccaaaacttttctcagcaatatcatgtctagtaagagcagaggaaaatatttaaaagcttggacttgggaacaaaatggcccagagtcacttcccatttaccacttatgaatggtgtggccttcagcatgctcattaaccattcagtgtcttaaattccttttgtgtaaagagagaatattatcatatatcatttaaaggctttataaagattaaatgagttaatatttataaagtgcttagaaaaaatgtctggcacacagtaagcaccattaatggcttgataaaagtaatttgacaggtaaaccaacagtactctttctattttgtaatgtcaaatcatggctacacttgaactctgagataaagagaaagattgggggcatggaagagtagcgtgtgtgcatgtgtgtgtgtgtttgtgtgtgtatatatttaggtgttaaaatattttatctaagtttccggaattctgcacaatgtagtgaaaataaattggtaaaatcacgtttatggctaatggcaaacatatatacaatgtggcaattactacttccaaaatactgttgaacaaaaaataactttatttactatatattttttaacatcagaaagaacgttgggatcctacaatcctgccaaatcttgattttgacctgtatggtactgggattgtagtgggctcaggtgttttgttgacctttgaattattagccatactctgaaagttgtttttgaaattgaatcctagaaaattcctgatatatagcttttttttttggaaacttgcattcagataatttgggtcttaaggtaaatttaaattaaccctatttagaaacgtcaaggaaattaaacatattaaagagatattggtgtcacatatacaaacttacatgagccttctttaggaagaagcaagcagataaatgaaaattagaaaaatattgaattgtggaaaacagaagtcaatgaggaaaaattagtaattaatccaatgtagtactctgagatcattgatgatgccttgagtgtggctgggagtctacctggattattgatggggagaaacttttgatgatcatggtgacaaaatcaaagagaaggcgtaaaggatacagttatattccctaagtaaaataattagttataggattgagaatttcaaataaaaagcaatatggaaaagcatttattatataaataatgtaactggcacagaacacagaaatgcatgaataccttttgaatttccaaataagatagattcctgtcaactctctagaagataggtttttttttttgcctctattgattctcttgcatgcacaaagtctttgaatatttgtttctcatcagatttaccttcaacagtattggggcctcccaattacatacatgcttttattacccaatgaacagaaaaaaaacaattactgttcatattatttcaactgaaatcaagcttgttaaaagctctctcacaattgttaattttgtacatttgcaaaaatcaatagctagaaaatttactagacacgaaggcctctgaaacaatacaaatgatctttatgccctagggctacgaatttattgataaggttaacaatccttgggtaatgacagcttacttctcttctgaatctagcctaaagattccattaaatatatttctaaacaacaaaaatgtctagatgagagtctaaactgatttcaagtgtttgcttcaaaggacaaaacaaagacagatgctcccttccagccaatgacttagacaatccatattaaagattgaagtcaatggtcatgatatactaggttgggcaatctggcttgaatgtgacattgactggtttaaattttgaattaatgttctctcaaaatatttcatccatcagttggtttatttacacttattatttaccaattactgacataggtgctaacacgcagcaaaaacttttaaaattatttttatttgtatttcctttttaattttaatagctttaggggtggaagtggttttttgttacacaaatgagttctatagtggtgaattctgagattttagtgcacctgtcacctgagtagggtatattgtacctaatgtgtccttttttttaatcgctagcccccctcctagaactcttgatgaattcagaatctagggagaaagtcagaaaagcaatcagtcaatacaacgtagtacagaggaaaatctctgaatagacttccatgtaaccaatgcctactcaggtaatttgccagattaacaaacaccctgcatttcctctgaaaagtacattggctaatgcccagggcaagatggatacttttaggtaatactcaactcattggtagacccatgaggttccgctctcacaagttgagtatgtacccaaaagctaacttagttaagccagttataattatttctagagttacataaagattatcaactgaaaaatgtaagctccatgaagacgagggctttgccgttcccaagtaactagactagatcctgcttaatatttattaagtcatacacttacaaaagtttttatttatgcaaaatctaaactgaatgttgtagaaataatcaataaatatggttgcaaaatgattcaaatgcttggacagacaaatgtaaaattttattaaaaataataaaaatctttagttctatgtgcagattgcttcacaaatatcttttatttctcattcagatataaagaaactgaaactggaaattatagattatgctagctatgagcaatagaactatgatccaagccacataggtaattttaatttgtctgatacccacattacaaataatgagaaatgggtaaaactaacatccatactgtattttacttaaccaaacagatcccaaatactatcatttcaagatgcaacgcatataaaattattattgagatctttcatattatttttacactaagtcttcaaagtccagtgtgtattttacatttatagtacctctcaattcatgctagctacattccaatggccatagatggcaagtggctaccatactgaacttcacagaagtagacaatatggatgtgatttctgtaagaaagagaaaaataatctcactctaatctgtgaatttctgtagtaggtatgaggtctaggtctatgtacattttgtttgtccgtggatgtcccattgatccagcaccatttgttgaaaacactactcttcctccactgaatttattttgaaactttgtcaaaaatatgttgggcatatttgtgtgggtatgtttctagactctttattctgttcaattgatctatgtgtcaatccttctgacaatataacacaatatttgttgctgtggttatgtggtaagttttaaaatcagatcttattgtataagcttaacaacatataatgttactgaaatgataacttccgcaatttggggaaaaaacagaccagatggattgaacactcctttaaactctctctctctctctcagctgtctaaatgcctcaaaatggaaattcaacagatgagagcttcttattgagaaaggggaagtagtaggggaatctattttgaccacctctctggtttgaaacctctgggggtttaagagaaaaggagattcaagatatggcttagttttaatgttaatgctacagtagtacagctgggacttgtcctacatttactgagaactctaatttacgaaaactagatcctagcattctgaaagcagatttgagacctctaaagctatttcttttacagttttttccacctttggttgcagtctattgtattgtcctgattctttttttcacctactcgtaggttattcttaatcacttgaaaccaaccacttctatgtatatgatttttgcttcctttccctcacagatccctcaggtaccctgtcttatacttttagtaagtcatgcaaaataattgagaaatgagtcatgcaatttattgctgcattttattaaattagagtggtcagatatacttttactgacagagatttggattttactgtcttgaaacagaagagagagcaaaatggttaagaaggtgatgagaaaatgaactgacatttatgtaacagtgccttattattaatatatggttggtgctgtgctttgtaccctttgagagatattttgtgatccaattttatagataggaaaaggatctctaaatattcagttttggaactgatgttctaaccaggtcatcctgacttgaaatttcaggtgattccctcatgatgcatcttgacgcaaacaaaaaatgtactgaatatattattataaatgtgagtaactagaaatgcatgggaaagaagaggggaggaaaagagtaaaaaggaatattaaacaaatgtattcaacaaacctttattgagtgtctattatatggctggctatgttctaggtactggaggtgtggtaacttgggaaaattttatcaacatatattacagtattttctgcataattccccgccatacttttatttcctttgaattcacagtttccattaaaataatttattgagttaaagcctagagcatagacaggcaacttttcaaagataccataataagtttttatttactcatttttgaaagaaggactagtcggatgctggccataaacaggggctaaaatttcatccatctttccatttccaccaatggaggtgtagagttggaatgaagttaagtgaccaagcctcttgagagaggtgaaggatatctcaggaataagcaactagcaatagacaaaggagaaaaatcgaaacagagagaaagaatggtttggtgctgtccattccccatccaccactgccaaacatacttatacaactctggccactcaaactacctaaatgagccaacttcgatgaaacaaacactattgggagagattacactcccgtggtagtatcaagtaagatcttatcctgcatttaacgcattaggaggaagtatttcaccagtagctaaaaacattattagtctaacattaactgtttctatcaaagggatttaattacatgacattaaatagtacatgcacttgtatacaaataatttttttctcaacaaacacagaaataataaaatagagaaaagactaggtgacagatcacatatattgagatacttgccataaggtgagactgatcaacatccttcttcaaggatataaaaatttaatttacttagagggggtttcagaaattactaattgaaagatcttacttaacaaattttttttacattagaaaaaatcagaacttggtaaatcctcttgtcactattagtaaaatcatgttaattagtccaaaactttattttaatacactatacttttcctatacttcagtcaataacttagtttgtggttttctataattcaatcactaagtttatttagagaaaaatatccttaacttggagtccagtggtctttgaatctcccaaaatatatgcaatattttatgtccatgtgtgtacatcatgagtatagattctgtgtttacatttgatttttaaaaagatgcatgtttaccctccaactaaaatcatgaatttattgttttaaatttaaaagttggctaaatggctatgatgtttatgtattttcatcaaaagggtagttgtttgtgttttatttccaagtctatgacttgatgtacaaaaacctttacactgtatcgtaccccaaaaacatactcagattcaaaagagagaggaattagaaaaataatgaaacatttcagtttaaagtgtcttctcagtggcagattcagtgtattcattacttttgcttcttctagagattaaagtgcataatctaatctcataaacagtagctaattcatactggcttaatagaagatcagttgggaataataagctcgatagaatgataacattattactggaattctcagaagaacttggcaatccaagcaagatggataagactaataaaatattacaaagaataaagaaaaagttaagatttatgatagtctatttatgtttctgttattatgtcatataataccataagctgaggtaattcatatagtctgttctacatttcaccaaatcacccttaataactaaacgataaagtgataaaattcaagacactgtgttggaaaataagagggcagagggaaaggagcttggatgataaataataattaactccaatttctaaggaccttaaaatctggttgtcaataaacatcaatacacataaaaattattgtatctatataagattggtaactacaaaaaaaaaaaaaaaaaaaagaatccccagaatccccagaccctgcagaattgggattgagggtagaatgacaagggtcctcacagctgacaatcatgggaacgacaaggagaacaaaagacatttcacacttctcaaagagattactacctgttttgaggatcacttgtcaggagtgcatcttctgtgactatgcagggtggtcaggtaaaaggaagttactacagtaaaggatggtgatgaggaatggtgagtttccaggtcactggaaactgaaagtctcctatgaactcgagaagccgcaaaaccaaggaagagaaagagtaattttataataaatgttgctgtggatttcttcatatctgttttaacacttttgagttatttaagtgtgtgactacttaattaatttttgttattgttgttttgaatgtggcatctacccaaaattggactgcattggtctctgtatttacaaggcttatatttgcatatattaacttaatgcaatacataacaaccagatgaacaatccagatataggggaaagtgattacaccttgtactgggatggacaaggaggacttaattaaggaatttagagaagctcagtcatgaaattagggtaaacttcaaacaagaaaaaaataaaaaaggatgggttgaaactagggtaggattgaaataagaaggaaatagatgaacattagagataatcacttaagtgaaaacataaaattgagaatgccttatcatgaaattcatgcatgaaattctgtcatgcctgttgatctgtttaaaaaataatagtagccacaaatattctcaaatgatcatgcatcgaatcttgtggaccccaagagtaatcatatccctaagggagctaaataacgtatgagtgtagatgtctattgcaatgcagtttttcaaaatgccattgacaatttgttgacttccttcaaggttggcttagctttctttctcagcctccaaaaggctatcaagtttcccatgtagttctttgagatgatcgatctatgttttgggaggagttgcaaaatatatgagatatagccaccttctgtatcagaaggattccctcttgggttatcagaacaatcaaagaagctatctgattactggaggagagactgacataaaattgtagtttttaacttcttgtgaaagttgtgagagcttgacactgcatgcaggagtaacttaagaacaatcttccctctgtggctttgaaatcaccccatgtgggataactacaaggcctgttattgttggaagagctaagcaatagtttaaagagaactagatttgttacaaaaatcaagatggctgcctaaaattcaacatactaggcctatttacgtatattatgcccaaggcacttggctggtaatacaggggctaaacaaagaaagaaaattagttcttgcctagggaaggaggaaaaggaataatttattgagtaccaattatacactatgccctttatatttatgtcatccaatgcacaaagctttattatgatttaggaaatattatactcactttacaggaaaaaagcaccatgaagtgaaaagaacattgactacagagtcagacacacctgagtttgaagtgtggcttagcctcttaatagttctaagaaaggaatttaacctcttcgaggccagttttctgattagtaaaacagggaagcatattaccttctattgtgaaggagcaaataccggctatgctgttttgcagttaacattcatatgaaaggtataagataataataagtaaaatgtattattttattaaatgtatatcatgttccagaccttattatatgctaagacttttccatatattatctcatttaatcttcatagcaaccaggtgaggaggggccaggaatttttccattattttacagttaaggaaactaaagctcagatttaaagaaacctgggtgcagtcaaatcaaaaaagattaagtggctgaaccggcatgagctatatcgtgctctcatctcagagagcctttcgcatagacatctgaggaggaacaaagggtaacaataacagctctttctctgaccctcctgattttcaagccagccccttccacatgcccacttcaacccttgccaagattcttgtgtatgagtaactctgttacctagtctagttttgcatgaatccctgttcctcttcaagcacttctttagcttcaggttttctaatctggaaacttctgtttctgaattagacctgaactaatttaggctgtcaaaaggtttgtgtcttgaaacttcccctgagtcggaacaataaatattgtgcataaatagaaactcagctgaaataaggagaagagttaatgtaaaaaaaaaaaaaaccaggtatacgtataattatattgtcaactaaaaaataaaatgaaataaaagcttcggcttcatacgtggattcagggattcacaagagagcaggtttgcagccacgaaaaagcaagcacagaagtgtgtgtgtgtgtgtgtgtgtgtgcgctcatgtgcacactcaagctgttgatggaacatagcatttgtgagtgaagggatgaaaattagaataggccaggcgcagtggctcacgcctgtaatcccagcactttgggaagccaaggcgggtggatcatttgacgtcaggagttcaagaccagccttgccaacatggtgaaaccccatctctactaaaaatacaaaaattagccggtcatggtggcgctccacttgtaatcccagctactcgggaggctgaggcaggacaattgcttgaatccagcaggcggaggttgcagtgagccgagatcatgccattgcactgcggcctgggctacaagagcaaaactgtgtctcaaaaaataaaataaaaagagaaagtgctcaaaagagaaactgtgtgaaggggacagtttagggcttggggaaaacaaaacaagaatgcgatctcacctagagaccaatttccacatgatcccacagggagctctggagggcaaattgcatcccagagctgatctcaccttgtggcaaatgggttggactcttgtactttcagtcgttggttgcaaactgacctgaggtggggcacatatggcctttcaggctcctggctttcttcagggtaagaacaagtctctggagaaggaagcagctgtgggcaacaagcactcccagcagctaggggatgggtgtgctacctggtgatggggacttcagtagaacatatcagtgcccactagagtcagagagaattgatttgggtcttaaagacagtatacaaacggaaattttattttattttgttttatttatttttttgagacagggtctcactctgtcactcaggctggagtgcagtggtgcaatctcggctcactgcaactgccgcctccctggttcaagtggttgtcctgcctcagcctccctagtagctgggattacaggtgcgcaccaccatgcccgactaattttttgtatttttagtagagacggggtttcaccatgttggccaggttggtctcgaactcctggcctcaaatgatccacccgcctcagactcccaaagtcctgggattacaggcgtgagccaccgcgcccgaccttattttattttattataataagaagacaacataagatctactctcttaacaaatgtttaagtatacaatacggtattgttaactacaggcacactgttgtgcaacagatatccagaacctactcattttttataactgaaacttgatatctgttgacaacgggaaatattttctttagtctcatgatattaaaaatgtatctgaatttatgatttttagataaagcactcatagagactattgggcaaaatacgaacagatgtattgatttctccaagggttccaaactggaattttaaaaaacttgagttaagattcatgcatatttagtaacaacctagtaacacggatgtatgccctcagagaatgggaatcagaatctaaagtattgtcactagagattgaaacaaagctttcaactccaattgttataaaagaaggaattagactattttgacataatccactgcaagggaaagtaagcagaaatatccagtgggatttggaggaaagctgtgtaaagggcgcttcttaaattggacaaaccctttcactctgctggagtccttcctgacacctggaaagaggctggaggtccagcagccattttagacaatgatgttacatcgaagaccgaaagttgcacagaaagatggaaggttcctgggtccttgaccaccatggccctgctctaccggcaatgtactgcttccagctggagctcactcatgtggcaaggcaacaaatctctcttacttaacacacttctatttctggatttctgatacacgcagccaaacccaatcctacctgatgcactcattttttaatactcaaaatgggaactatcttaccattatcactttttgttacacctcagattttcctgaaaaagtgcattgtcaaaacatatcattatttttaaaacaaagagtgtataaatgtattattaaatacattaaaaccagacaaaggctcataaattaatgcaaacgtgtggaatagtttcatcacacaagtgaaaattaaattggactgctctgccataataaagctctgtttgcctgctttgaaatgaaaagcatcatgcaacttttactgctgcgtttctttgaaaagtaccaaatctctcttctgagttgctcttgtctttttgagtataaggtatttattaccactgggataaaaacagaatgttgatggtcacatgatgcaggcagctgggatttcaactcaaggtcagtcactggaccctcaggcagccagatagtgttgtttattttttgccaaattgatgatgcctttagcctttaaataaggagcactgactatgattaaattttgtcctaaagagatatttcacactctaatacatagaatgtatctcattaaaattgtaacagagtaagaaaagcttacttcagagatctctcagaaaaaaattggagtacagcctgaagttatctaaaataatcagcatggaaccatgcagatttgaaatcagatgacaaacatgtactttcaaagcatgaacatttgaaaacagtaacttgcatcagtttctaaacgagggatttaatgtaactatcagaataatcagtgtgagatactgaaatataaaattgaatttgggtcttcagaattagaaacttaacagaaaaaggaggtcattgtagaaatgttacgaaataattttgtttttatgcctaatttagaaattgaatgggccgggtgcgatggctcaccactgtaatctcagcactttgggaggccgaggcgggcggatcacgaggtcaggagatcgagaccatcctggctaacgcagtgaaaccccgtttctactaaaaatacaaaaaaattagccgggcgtggtggcgggcgcctgtagtcccagctactcgggagcctgaggcaggagaatggcgtgaacctgggaggcggagcttgcagtgagccgagatcgcgccactgcactctagcctgggtgacagagcgagactccgtctcaaaaaaaaaaaaagaaagaaaagaaattgaatgaaagttcattgataatgcagagattctaaaataaatgtagccaaaaataaagccaatcagcataccaaaactattacaatcttagaaatccattatgatttttaaaaagtgctttttttttttttttcctctgagatggagtttcgctcttgtcgcccaggctggagggcaatggcacgatctcacctcaacctccgtctccagggttcaagcaattctcctgcctcagcttcctgagtagctgggattacaggtgtgcaccaccacgcctggctaattttgtatttttagtagagatggggtttcaccatgttggtcaggctggtctcaaactcctgatctgaagtgatctgcccaccttggcctcccaaagtgctgggattacaggcgtgagccactgagcccggccgaaaagtgctatattgctattccctactatttattattctgaaagagacatatcacatgtttaaacatttaaataacgaacaaacctcctgggatcatcatatttatcacgcactttttaaagaaaatcaaacatgcttctgtttatacaaatttattcccattctaaatatttattttacaaacagaatactttcttatattcttgggctacatgaatcattattatcaacagaagggtgtctgtcattacaggaagcacaatacttgtatacttttgagggttactcacacacacgcgcacacacacatgcacacacatacacacagagtttgggacctacaagactttataatcttattatgcctgctacccatttcatcttcttcttcactgtttgtcttgttgtatctctgttcgttgtggcctacccacccctgctcctctctgacagttttgggttgaacttacctggctctggttccaggagtgggtgtctgatggaacctgcccaatcagaacactgtactcctgaactaggttgattgattcaggaatgtgtaggtgatttcttcagagtcaattacaagtaatcctaggtcttctgttggagagaatggtgttttcattttctattggaattgaggtacaatgatataagtctaagactaataatgggtcccatatcgagagataatgtctaagagctttttttttttttttttttaagagcctttgaaaacacagtggagaaagggtgagagaggtactgggctaggtgacatcacttgagatcccaaaactaactgtatctgaagtaagtaatacctcttcactttttcgttacatgagcaaaggaaacttttttttttcttaaactggtttgctaggtttttgtaaattagcagaaatggtgcttacatacacacatatatgtatgtatgtatattttggttgagattaagaaatagagacctaggttctaatgatataactgactaaagataaaattaatccaattattgaaagtttcagcacctcagttgcctctttaaacaatgagttagttagattacatgactgacagttgtctagatctaaaatcattggatccaatcaattgattttcatgaatgaacaaagacatttaaatctggaagtaagttctattaaacctagtatcttgataaccccaggccagataaaactataaaaaaaaaatgactggtctctatatcagtcgatgggcaccattttatagttaatttatttcaggaacatggcagttataacacaggtaactataggacaagctggtaaacctcattgtaggtaatcactgagctcagggaggtagcatgatgtggtggataacagcaagggatagggaaggagaaagtttgactttcaaagtctaattctaactcagaattcttcatctgtaaaatgggaacaataatagctctctcacaggcttgtcctaagtatttactcacataatatacacaaagctcttattacagtacgtagcacaaagtaagtactcaaaatttgccatatgtcattattagctgcggagctattgcactgaccaagtgcttgaaaaaacaaatcatttcctttggcgtgagtgttaatgcacagaggctttgaaaaatactatgtgaaagtcattaaaaaaagaaaacctctcagcagattagcttccttcaacctttgtaagatcctgcttttgacggccaacccagtgctttccacactttctcacacattgcctgttatttctggtcaggaaaataaataaataagtgcccatctggccaagtatttttccacctttatatgaaccagaaataccaattgtttctaatgtgtattccccagatgcaatacttatcctctatttacagctaagccactgattactgtggaaaatattgtcagcaaaccataccccaaaatgtattgctgtgaaaggggaaaaaaatattacaaaacaaaaccctaaaccgaatcgataacagcactcatgtcttggatagatttacagaaagagaaggacgtcgctatttttatttgctaagagatgttgcctttttttatattaaaatatttaaagttacttctctgattgatctgtttcttttgagacataatcttgctctgttgcccaagttggaatgcaatggtgagatcatgactcactgtagccttgacctcctaggctccagtgatcctcctgcctcagcctcctgagtaggtgggactataggcgtgttgtcactatgcctggctcatttcttttcattttttttttgtagagatgaggtctcactctgttgtccagggtggtcttgaactcctgggctcaagggatcctctctctccttggcctcccaaagtactggcattataggcatgagccaccacacccagccactctgatttctgagtcttaatcaaagtagcaaacttataaagtagtgatttcatcacatgccaatattaacaaagaaaaaggaagagtagaaaaaaaactccataactgatactgtaaaatatttttctaatttgcataaagatatcagttctaccctagtatatttacaagatatgacaattcactaacatttacattttaattcatataaccagtttgtaagagaaggaatcctatcaaggaaaataagcctacagaaaactaactttttgtgataaaatgattttataaagctgacaataagcatttaaagaagtactagaacatgaacctttaacacatatccaatctactgttttagaaaaaattaagaatgagtttttctgcaaaaatgtatgcaacgcaaattctagtttaaagcggaatatcctgtaatctaataaatatggagatgattttttatagtgatgtaatgggctagattgtacctttagacttatgggaataaaaatattatttcctaatttcaaaactattttaaatcttttaaattctactaaattaaataagaaaataaaatttgagttagccactcaaacaggagatttgttattctgatttaaaaacaattgcctttggtaacaatcactctcaaacagttcgagaaaaatatatgtatgtatatattcatgggcaaggagaaggatttagaaaaggagaaaatttttctaagtttcggtgatcaattggaatgaaagtgtgaaattaccttcagcagtgttgtcaactaaactcagcactttctgtctcaacaggtgcacactcaagcccaccaactctcagctatttgtcaaagctaaggaaaaagatagccagtccccacacagctgcgcctctggctgccactacaaaagaatgaggctcggctatttttaggtttggggtaggcaatcagccaaatctcagcagcaccacaagagcatgtgctgagataactgagactttagagttgaaccaggactccaccagcctcccaacttcctgcctagacacccaaccctgtgttctcatttctgtggtcaccaagtcacctgtggctttcatcatgatccgcgaaatctacatttctgtgcttttcccagctcctctcctgttacaactttcatttcttatctctagaccttgaagccatgaaattttccttattagttcctttactcaacaaggaaaaaaaaaaacctcagaacactctgcagctgcttctataaagaaagcagtgtgggtttaatttgtttataatctgtccttcatttcattaagcctctaagtcatggccattgctaccactgtgcttaaaaacaagagaaaagtgaatgcttataaagagtggcaggtacaataactgatgtacaaagaaggaaaacacagattactgtgttttgatagttaaaagggagccagaatagggagctaaggagtctgatatcaatagcgtacattattttacctttgttgaatgctgatccagaaggttaatatgtctaagaatgtgcatttgtgaaatttccctatgtgctagcataatctcactaggtgttgcatgatttccatgaggaaagctgggttttagtggaataaattattctacattagatttttttgtcttctcataactgttttttatttgtaaacaaaagtacatgcacacatttacggtatcctcaggtattgctatcaaaacagtaataaaataacgcactattcttttttaatgatttttttttgttgtgaactgacatgagctttcatatacgaaatccgattttgaaatataaggcacatttattttgaaattaatagggaatctaggtcaaacaaagcaaagccaaaccttaattttacagaactgttctacctctacaaaaagtcactcaaaacaattgtttaaattgtgtgcaataattatcttgaaaatgcattttaacatgttcctataaatataattccatatgactaagatgaaaataataaataaaataatagtggaataaaattgatactttatttcctattttgattttatccccattattccagaacaaattcaatatggcagataaattgcaaggatttattttttctttctttttttttttttttttttttgagacagagtctcgctctgtcgcccaggctggagtgccatggcacgatcttggctcaccgcaacctccacctcctgggttcaagcgattctcctgcctcagcctcctgagtagctgggattacaggcatgcaccaccacgcccggctaatttttgtatttttactagagatggggtttcaccatgttggtcaggctggtctcgaactcctgacctcgtgatgctcccacctcggcctcccaaagtgctgggattacagatgtgagccaccgcgcccggcccagcaaggatttattttcagggagccagtattatgcagagatcagcctgctttagaaaatacagtgtctctcatgaatgagtgcaccatttgccaaaaataatctattgtatcttcttctcaggccaataattaaaaatgtattatactccaaagaaaaacgtaaataaaaaagacaatcctgtaaaattatatggttattgtatctctacaaaaacgtttttaatattgtaaaatatattatttacataaatatgtaaacattcaaattgaggagcaagttttagagtagggctcaaaatctcatatctgccacttattagttatatggccttgagaaagttacttaagcactgtgcttcggttttgttttttaatctctaaaatgggaagtattctttcctcatgatctggttctgaaaattaaatgaggcacaaatattcacactcccccagggttctctaatcctttccttgatagtgtattccctccgttagaaatctcgttctcttctttaacttcaactatcatctatctccatgtaagtgattctcaagtatttctctcttaagtctaactctttagttttagtcctcccccacaaaaacttttattatctacccacctggatagcccatcaacaattctaagttgatgtctcaaaacaaaaggcccttttccccttcccctccaattttgatcctattcctggtttctctacttctgttaatgttaccatcatctcaccagttcctcacggtgattagctattaacaattttaagaattccaacatatgcttcattaaacattagataaatgggcatttattgactgcatgttaaagaagttccatggtgaaatgagtttgggaaactaggttaaaagttaaacagctgtctttcctgcaggattccagagcatctttgcatatgcattacattgagaaactctaaggggatttagtatgtagtattcccctcagttttatgactaaagaagtcttttttgggggcgtggggccaaacagagggggcccataatgaataattactgtgccatagagcactcttgggggattaatatcagggagtctgctatcattattcccttttcctcatctcccacaatttagcaacaacttactaccaaataatttggttctccttgttgaatccctatctcattctgagctactgcttttgtaaatctggcctaggctacatgtaggctctcctttcactgccttttcttattctaacatctcaaactctcaattcaatatcttctgtagaatttgagatctattttctgtaagagatacaaagatgggtaagacatgatctctattgtcttgggatctgtgagagatgggaataggccagcagagttcaaatatatattcaataccataggcatagacataccacataaatgttgtgaaacaagaaatagcagtcaatgcttatatgggaaaggttacattaggtttttttaaggaagtgggacctggataatattagtccaggaacttctaaatgaaagatttaaaagtatttatctaccccaaagactatcttctcatcttaaactaaaaataagtttaaaatataattaatattttcacaataaaatgctcactggagaaactttgaaaaaaataaaaatgtaaatataagaatattgaagtaatccagcgtgtaatttcaccctagatacatctactgctaatgatgggtgaaattttattttggatatttgacttgtctacaagtcaacaattctaaagatttagcttccagagctaaagttttctaacaataatgccaattaaatgttttaaaaggttaattataaaagatatgatgattaaatttaaaatatcttgtcacctcctgttcacaacattttgcttttcatttccatatatcttaagtatacatctgaaagctatgtgagcgttgtaaattgtcaagttgaacttaacaaagtatagtttatgttggggaaaactcattaaaatgggatccatttcttaatttccaaaagaatcatctatatgaattgaacattgatttaatatcattgaatattcaatacccatatacacattagaatgtttttatgatttacattgcttacagcacagaatattcaccaatattattgctaagagtagagatatgactcaaaagtatcaatatttaatccagtaagtatgaagctctatgttaattgcaatcactattcataaacaatttgcccaacattgcctaaacatttcttgccattcaagggtttattttttgccttctgtgaattagagtatgatagtaaatggtaataaatgatcttaagtgatagtaaataagtaatttctataacagaataacttttgttctagagatatgtgcaaggcacaatatcactacactcaactgtatccaaagcaggccacagatccttaaagagaaaacttaggaatttactgtggcaacaggagaggaaaaaagcaaataaaaaggaaatgtacaaatgtaggtatgaggaggatgtccttttctaaaaaaaataaggtagtttagcatagttgcaatgtgtggtatatgagtggggcaaaaaatgaggtaggaaggacaaataaaggaccagtaacgaagagcttttgaaatttatttcaggtctgggagtgatgattttgacttaattccctggttttctctaatactgtttgttgttgttgttttctgcatatatagaaaattggtagattttatacatgtgcattacatatgtattggtagattttatacatacacatatatatgtataattacgtatatacatatacaattgttgaatcattaagttgcaataattaaatttattactctttatgatgctgtgggtattacagaagcattgtaaggtactacatggtcctcttataccatagattttttctaaacctacaactgtatagcgtgtggtatgatatgaaaatcactggctgagaactagctgggtcttagttttgtatctaactgtttctgagaactggagtctcactttccacatctatataatgaggaaatggaaaatattctccaggttttctgcagttgtgatgatctatgaccttgttattcactgtagggtgttaagctggtgaaacagcaaaactgcagaccaaataccagttttcctttaaccatctctctctctctctctctctctgtctctctcatcatctatctaacatctactattttaaaaaatcatcagtcttctcaatgcatatcttactttctccattttcccattcttccagccctttgctcttttcggacaccttttatttacccgtctacagttcttttgccctctggtactttgtggttaccagttgctattgtacttcccacaaaggatcaatttgcactacaatcatactgacagcagtcctcagtaactcaggggaaaaaaaacagactcttaagcagcagtggggatccaaagaccatttcccagggaaccagtcgggtcacaggaagagtgggaagagaacagcaaagccccaagttattttcctcttcccacatatttcactcagatgccaatttttgtttgctctcaaagctgttttatttgacagggctccttgttatgggctaaattgcccctttcccaaattcgtctgttgaagtcctaacccccattgtctcagaatgtgactgtagttggagatagggtctttaaagaggtatttaaggttaaatgaggtcactaaggtgagctctaatccaatctgattagtatccttataaaaagatgagattagaacacagacaggaacagaggaaagaccatgagaagacagatggagagggcagcctctgcaaactaaggagggaggcttcagaagaaatcagccctgattatacctagcctttactactgtggagaaaataaatttctgtttaagaaacccagtctactgtggtattttgttatggcaatgctagcaaaataatacattccttattcatttgtaatgttttatatttgaattcagatcattctcattctcccctttgtatatatatatagatatatatccttcttgctgctagaacaataacaaaaagatgattaactgtaagcatagtgttacaatgaactctgttgctcacatgcccttagatatgtatttgtttattcaaaaaaagcattaaccaaataactttatatattaagccttatgctcatctctaggtatgggggagaggtgggaaacatgatgataaaataacagtatccgtgtaacactgataaacatgccaagatatttgtattctcatattaaagtaaataaattgacaaaatatggtgaaagatattgtgcattttgatgaacttatgctatgagaacactttaaaaccatacctaacctccattggcggagtcaatggagattggtgagaggggttaggaaataatttttcctgagatgaagtggaaaccaggctttaattaattaagtgattggtaaggagaaggagggtaatttcaggaagacttatccctgacaacacgaaagcatggtagtttgggggcccgcacataggagcctttggctaaagggttaggagtaagagatgaggagaagggtaggagaggaggtagcagcaataagctgggtcctgataacatgaccttacatacatcacggagttggcattagtctctagcaggaaaaaatattttccaacttttaagttaaggctaattttaaacttgtcacctgtagtaatctctttaaatgaatgaaatttccctgtcttcatttatagtaatcagcatctttcactgcaaggaaatttctaagtgaatgtacattttactcaacttctaatttcctttaggaatctaaactcattcaatattttcacaaaatgataactgtaatcaaggcagagagctttatttcagctaacaaagaatagccctacacaaaggaattgcaaatattctaaataatgactgttataatttatcttctctgttgaaggatactacttcctgttctgtttgtagccatgataaacaaatggtatcatgatccttatagtccaggaaatggactgttttatgtagatgaaatattattattataaaatctgtctcacattccaaacccagcctaggacaggatttatgataactgccccccatctatgctggatatcacactatgatgacgtgtgtatttgtatttctgtgagctcaattcataactatgcaactctcctgaagcataaacttggctacatcaaaatggctaaatatttggtctaatgtttttctttaaacttaaattataagtttagattacataccttaacttacttaaacaattggctggacatttgaaaaaatattgatctttctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcctgatctttctttctatacatataagctttctgtccaatttataaaaggaagtagtactaatatataatatataatattatatatatatatataatatataatattatatattatataatatataatattatatatataatattatatatatatataatatataatattatatatatatataatatataatattatatatatatatataatatataatattatatatatatatatagtgtacacctatactgccctagtaagaaatcaggaagtcagtattgatgatttgctctctactatttttgtctctctcctcattacccgcgcaaataagttttactaattaaatatctaaatatcttttgtttgcattttgtctttttcattcctaatgccctaaggctcttatctgggatataactgcaaccctcttacacctgcttttagaacagtggctctaaacacaatctgcacttggtgtgcctgtatgttctgatttcattggtctgcaagagttttcacaaaccctgtgtcatctaacaaatagatctgaacctcctcctttaaaaattcaagatgcaaaaataaacacttcttgacaacacatagtttgctttcttagcttttttacttttacttttttttcgttttttttgagatagagtctcgctctgtcacctaggctggagtgcagtggcacgaacttggctcactgcaacctctgcctcctgggttcaacggattcttctgcctcagcctcccaagcagctgggattacacgtgtgcaccaccacgtccagctaatgtttgtctttttagtagagacggggttacaccatgttggccaggctggtctcgaactcctggcctcaagtgatcttcccgccttggcctcccaaagtgttgggattacttgcatgagccaccatgcctggcctgctttatggttttattttgctcactgtctaagctagtactaggtgaggagtagatgctagaaacccattgtaatatgttgctcagagccagccatttctctttccaccattcatacccaaacccaaaccaaacaagaataatgtgagagatcagccatgctaggacctatcaattcagtcatcgttaagcaacaatcactagagacttagtacatgtgatatgtaacagcagtcactgtgtaaataaactcaccgcctattgtgagaaacagacctgtaaacagtggataaaggacaagaattgcatgcagttaaagaaaaacaggcaaaataccctgggaattcagaggaaggaatgccaaatcacccagttcacctacatctaaagaaggctttttttcttgttcatcaaaatactcgtgttggaactagcatgaagagtgtcacttcaccttctttggccttttttacccttttgtgtaaaagaagattcttgatcttcaaagcataacagtcatgttttattttactctatgagcagattcattaagaatgtgaaagtattcccattcattcaaattaacattaaaagacactctcccaatgaataagatgtcaaaaatcatgttagtaattgcagtcaatgaaatgaatgctctgctctcatgctgcatgcctatttgtactcatcgactgagcactaacgagaaatacacacctaacttagaacagcagaaggagcagatgctttaagataatatttctcagtaatatgcaacaatttaatttcaaatactgaacttctgggccttggaaattacatatacaggttttgcagtcaaatgagtattgtttagacatattaaatgtgctgagatctaaaatttcatcagttttcaaatttaagccagaggggaaatataccctaatggttcaaaaaccctcaatttaaattctggtttatatagcaatgatcttggttactttaaatttatttctaagccatgatttttttcttttagtggcaaatattacaataataaattcaagggaatgttaaaatcatacccaccaacaaaaagtaattcatacctctgaagttagctattttagttggacaatactcttaccttgcgacttatgctattagattcctgtgttcatctttttatagcacacaaatacacaggtgttcactcacacagatgcattcacgtacacactatgaaacttgagttttacaggaaaaaaatttctaaaatgtgtccaaataaattctaactgtaaaatttcttctctcggctgggtgtggtggctcacacctataaacccagcactttgggaggctgaggtgggcagatcacctgaggtcagaagttcaagaccagcctggccaacatggcaaaaccccgtctctactaaaaatataaaaattaggcgggcatggtgggacccgcctgtaatcccagttactcaggaggctgagacaggagaatcgcttgaactcaggaggtgaaggttgcagtgagccgagatcacacaactgcattccagcctgggcaacagagcgagactctgtctcaaaaaaaagaaaacatttcttctctcttatgtacaaatttctcactccatttttctccaatgggaatttaaatttggaaccactctgaagctaatgtaatcataccagatacataaatatttcaatatgtatagcaattgattttgttacagtctttgataaaagagatacagtgtatagacacaattttaatggtttcctgcaattggaaagatacttggtatattcatcaattagtatcctttttatacttctattagaaaggctatgtttttgtttaagtacccaagattccaaaagtgaatttgtatctatgaatacagtttaatgtgaacaattgaaacgcgcatgcaaaactcaaatgaattgtatacctggcaggcaggatgaattgatagcatgttatttttagaaatctgagtgtatgtatgcataattctagtttttgaagttatctgagagtctttccatatcatattatacccaaaaaattaagtgtcatcatctaatggtttgaaacaaaagaaatttataagtaacttataattctttccatcacttttggatattaattaattcaaaacacatttataaaacttcttcctagtacaaggaaatattcaaaactctatgagaatataaacacatagaagatgtggtttgcggcatccaggagtatataatctagtagcggagataatataatttttaaagttatatttcaaataatatagactcagttacctcatctgacaagtgagaatggtaatatattttttgccatagtttttataaaaccaattatatgtatattatctttattgtctttattatcattatcattcactataaaagataatgaatatatgcaaattaatttttcagtggtagaacttgatttctagatgtcatgaattagaactctactcttttccatttctcaatcagagtctatattttcaactttcaaaattgcacaccacatttctacaatgtgagccccaggcagaagaatgcttataagctttcatctaggcacaatatattatataaggcctggatggttttctggctggtcaattctctgcttttggcatacggagatcaaaattgggttatatgatctaatttagttgaagataatacaataatatacactttcattaagaaaaaatttaattatggaactatcatcataaaaattgtcatagataagaacaaagatactatatcgcatcttttctttggttgaaattttataagtcaaaatagattgtcatgtcacatacaagcctctttaacaaatctcctcaaagataaaatattaaagaaaaagttactatggtcttattagtttacagaaacttaattttattataaaagcaggtcagagggcctactacttcagtaaattaatgatatcactcaagctaagttttctcataaaatgcctgtgcataccagatctgtggatttctgtaatactttggaaattgaaagggttcaagacaccagtttttaaaaattcattattacatgaataatatgttaacgtaatatacaaaatatagttcatattcactggtcaataaaatattacaaacatttaagtgcaaaaataataaatatgaataggttgttagactggctctgtagatcctatttttgttttcagagtccattcaattccatgtatttgagtcatgcaataaacatttctcaccttgaatttgggcatacttgtatggggctccatgcttgtgcacacatatttatccagacactaagtttccttttataaatgagctcaatcccagattaaaacagatgaaagatttccaatcattgtggccagctcccagggtggaaaataagcttaggaatgcagcaaactgaaactgaatactctctggaatggacattccgttctaagtctccttcaggaaacctccaacaatagctcaagcaggagcaaacacttgtctttgaggtagtccaagccaaccattcactttctcagtaatctgtcctcagacacccactggacttagagctcctgtgcccacctcaaaggacagcagccctggcatgcatgcactataggagcagaagtgattctccaaatttctactctgctcacctctccaccactttgcatcaatttggcatctcctaagatatctcagctttgtaactcctcaaaggaatccccacaaattggggctcttttttaacttggacatttcctttgagactaagaaagaaagagaaaacaaagtacacagataaccaaaaacacgacagattatatgaatcatccaaattaagcaaccaacattttagtctaagatttataatttttacaatatattgagtacactggacaaaaaagtatctacttaggattatcccatcctgttctattttgtgtgtgtgtgtgtgtgtgtgtgtgtgtgtgtgtacaaaataatgcatgccagtattcataaggcttttccaatctgaatgatgcctgagtttcaaatatgtatacagtgatgtaatggctaaacaatagtcagataaatgctgtgtagtcattcatttgtgtacctacaagctgttaggcacaattaatccacatataataagcacaggctatctcctcaaggagcaagagagtgagtcagaagccgagaagcaaactgacagctaaaataggggatataattgcttgtctagaattatccatagtgagtttacaataagaatacatattggggccccattttctgacctagggtagtaaggaattcttttaaacaatattctataaggaaagataaaaataatattaatagtcattggtggaagagacatggtgatagtggtttttgggagaacattccaagaagtgggaacaagtcatagacacaaaattacatgaaccaaagttattttatttgctgaaccaaagtaattttatatctagacagaagtgttcctggtggggaacagcagatcaggaggtgagagacatgagcagatgccatactgtgaaagaccttgtacgttaggaccttggattttaccctgaagctagaagattctctaaaggacgttaagctggaggcacacaatcttatttgttttagaaactcaacgggggcagcaattacaaggtgggattttctgaagaccagattgaaagcaaggagatcattcacacacgcacaaacataaaatcagaggtagtcttttgatctatgtatctgtttatacaagttggtatccaaatgtacatttatcttttagagttatatacattagttatttgtgattaacaataatagttaaaataatacaaagaaaaattattctcaacactttgaccctcaccaagaaactttatatatcccccttttaaagccaacaataagtaagcttgtgaaggggcattatttttcctaatttcctcttgaggacagtagtagacatgctcagctcagtgccagaaatatggtaggctctcaattaatactagttaaataaatattggcttgtccaggattacttgcctttgtaggtagaggcaagtttaaaacccaggtagtctcaggcattgtcaagttaccatgcccgtggaccagcataacttctagcgcttgtcatatagggtttttggtcataaacaacctgaaacacaacaccttacaaagtaggacatatagaatacggcctccatcatcatgatattttattcaatcagtgatgcacgttcccatataatagaaatggattgcattctagcagattagcattaaaccatcctttgtaccttgagtgatagacttattaatttacaagacttatcctcgattaggtttggtgatgataccctagccttcagaaaaccaagagcttattaaaggtctaatgctgtatttttcaaatttttattttgcaatcattatagactcacaggaagtcgcaaagaaatatgcaacaatgtcttgtgcaaacttcactttacctctcccaatgttgataccatgtataactatagtacaatataaaaactgggaaattattgctataattcatagagcttattcgggctttaccagatagacaagtatgcacttgtgtgactctggtgtgtgtgtgtgtgtgtttgtgtgtgaagctctattcgacattatcaagtgtagctttgtgtaacaaacaccacaatcaaaatattgagcaggtccatcaccacaaggctccattgtggcaccattatatagcataccctctgccttattcctgacctctggcaaccaatatctgttcttaatatcaatatctgttcttaatatctataattatatttcagtaatgttatatacaagaaataacacagtatttaacctttgacttttttttgctcaatatggtgctcttgacatccattggagttgtgaatattgagtatcagtagttcattcctttaaattgttgtgtagtatttagtggtatgagtatataacagtttgtttaacagtcactcattgatggatacttgagctgtttcttgtttctagctactgcattcatgtcaaggtttttgggtgaacataaacatcaattttctgggataaatatcaagagtacaattgctgggctgtatggtgactgcatgtttaattttagaagaaactcctaaactgttttctagaatggttgtaccattttacattcccatcagcaatattagaaagacccagttcctttgcatccctgttagctttcagtgttgtcactgtttttctttttttaattttagccattctgataggtgtatagtgataactcattgtagtgttaatttgcatttctttaatggctagtgaagctgaacatctttttatgcatttctttaccatctgtatatcctcttcagtgaaatgtctattaaggcttttcccacatttttttccactagattatttgtggttttagtgctcagttttgagtgatatttatatattctagatactagttctttgagactttacaaagatagattaaggaaagaaaaaggacatgggttaaaaacagtaaaaaacaaaatcaagaaccacaagtgaaaagcagtatgggaaatcaaaaaagggaacagcacccaatgacaaaaagcaaatctttattatatatttatatatgaagctttaaccaaaatgaaagtgctttgtcatataaaattttcataaaatgcaatcaaaatatcattattataacatattatatgtaaacatctgtaattatgttcattaaagcattacacatcaagtaacttatttaaaaatatatatggggaaacctaatgtgtttggttccaggtaataaagtggtgagcaagaacagttgaggtgtcttggttcatagaacttaccacataatccgactggcaagtattaattagtcacgtacatacatatggaatcataacagtgctatgtgttatgaacagatgttacgtggtagaggaatttgatgtacttaggggattttgatgtctatccagaggtaagcttgtaggtggaaaatggtgtcatcaaggtaaaaaaggggaaacggggaggttctagacaaatagaaaagcatacacaaaagtactgtagataaaaaaaaaaagctatacctagtcagggaacaaaaagaaagccagtaagggggcgaggcaaaggaaacatgatgggaaatgagataggagaggtaggcagtgtctagactttgatttttaaatgtgttttgttttgttttgtttggctttcctagcaaccaagagaaactactaacatgatttaacaagtggtggtatcttcgaatttaattggctgcatgaagtttagagagtggattatcaagaatacgaaagagaatgcagagaaactggaaaggaaaggctgctgtattcctagtgagagaaaatatattgcgctaggatgatggtagaggagataaagagaagtggatgaaaatatattagaggataaaacccacagtgactggcaatgacttagaaataactgggtaaaaaagatcagagtttcaaggatgagatatgtttctggcttgtgaaactgggtgaatggttgcaccattcaatgataagaaaaacaatgagaaggaagcaggttttgtgcggtgaagagaaagttctgtttagggcatttagagggaggtgactatcacataagaatggagatgccacccaggcagttgaaatcacagttctggaattcattggagaaatctaagctagaggtataacttggttagttatctgtatataagtgttaataaagctgtggacataagtgcaatgatcgaggaagagatcattatgagaagagaattatgctaggactagatcccaaggaaacctaatttttaaaggctgagaagagaggatcagcctgcaatgcagactgaatacaaacaccctccaaagtagtagtgaagccatgagaggacagtgcacagatcttaaagacgacaacatttttaagaagggagaaaatggtcactattgaccttctgcaagttcaagaaagacgaagaaatttcattaattggttctagagacatgaagtcctctacttcacttgaacttagcagggtgaagcttgaatagaaaaataatgaaagcatgcaattaaaagaaaagagaatctcaatatcttgtccaactgatgcatataagagatagaaagaagataatactttgctttatttttgtatttttaccataacagaatttataatctaattttcttaaacaaattatcaaaaaagaaaccaacaaagttactgctaatgttgaatattaaagtactattattaatagcttcttaattaagaaataaataattatatgtttgttacaattgggaatgacatttgaatataataagttgtttttttttcccaaccgtgttgtagtgttctttacacttttcaaatggaaaaatgtattcagtgttgtattatttatcatgttactgatcttatcagtaaagccaaaaactttcatacgtaaaccacttaatttccaagtaatgtgtatgtatgtgtgcctctgtgtatgtatgatagacagaaagacaaaaagagaagatctatgcacactagtaatattgaaagaaatgagctaatttacttcattcatcacactgtcataaagactttcttttttcctagaaaagtggtatctcatacaacctcatctaatctcatacactagaaaaatggatcagcattgattaaaataaaataaattctaacaatttcttatttttatataatcacacatcttagtgtcattatagcagtaagttataaaaacaatgtatatttgtatatttaatattaaagagtagtgctacaaattaacctactgggtctccgaaatatatttctgaattaaggcttatttctatagcttatccaaagatcaataaccttacagttaagaagatgcattttaaataaatgttaaaatttatattatcctgatagttttatatactagttagttactggacaatactaaacaattgataccatggaaacgcacatgataatcaatagacttttttttttttttttttttttttgagacagagtctcactctttcacccaggctggagtacagtggcgagatctccgctcactgcaacttccacctcccgggctcaagtgattctcctgccacagcctcctgagtagctgggattacaggtgcacgccaccacgtctggctaatttttgtattttagtagagatgtggtttcaccatgttggccaggctggtctggaattcctgacctcaggtgatctgcccgccttggcctcccaaagtgttgggattacaggcatgagccaccgcgaccagccaataaccaataggcttttaatttgaaataaattattggggagtatttctgacttccctttgcctcccaccctcatttatacatcttgaataattctgttccatcacgatctctgacattatttttaaatatgtagatatgtgtgcattcattacctctttatgagatgagagaataaaattgcttgtgaagtcagagaaactcagtattatttctaatcatatatatgagaatgccaatgttgacgttatcgtacagagtgcacattgcttaactccaggggtgtcatttacctcatagcataatattaatagtccacgttactggtacactctagaattgtacagtgtacactatatgaatgtatgcaactaaatatcacactgtggatgactaacataatgaagataagagaaaaattagtttatgtaaaaaggcaacagtaattatagtaacttaaataacctactgtttatgccaagtactattcagaatagtatggcacgttaatctatgtaaaccatttttttacaatactaaatcatgttcaggttagcccagttcttagctttttgttcatgtagcacagttgcctgtacataactgaaataaactctaaaagaacaactagtgagaccactctaaggatggctaactgtagatgattacaaacaaaccagggctgcattagttttatttttgatctttttcatcttcacaaagtaagaagagtgagatagtaataaaattgtgaaacaagataactgttatggatattatcatagacagctccctatgcaagtctagagaatgggcatgagttatttaggatatctcagtttttatctaagaaaatataatatgccaatgtctataggctttgagtaaacaacccaaaattttaatgggttttatttttaaagagcatcctcaatgggacatgtctagttcttgttagaagatactatgattcctgccattttatattttgttctatcctttttagaattctattaaaatctgagagatcgtgacaactgactggttaagaatctttaatcctactgtcatgctgccaccattaaaatcctgactctaccacgtaccagctgagctaccttaagcaaattacttaatctccctgtacctctacatattcatctggtaaatttagatgattatgtttccccaccttctagagttaatatggaacttatcacatatgtatgtgatgtaatcagagaagtgcctgacacttattacaggcttgttaaatggtaaatacagtattatcattgaagattaggtgaatctagaatagtgctatgcacacacaaggtactgtcaatagctgtgtatgtaagacagatcaatgtttcattaatcctttttgcctcactgcttcttgcaatcattctctaattcacatctctgtatgtccatactcttatgcctatttataaaaatggattcttcaatgagaatgtccataatcacactattcataagtaatcatttatgattgatttgtaccatgctttataactttcttgatattttatagtagttgtacgcatatacatatgtgtgtgtatctgttctctgacttagagttgctgtctcataaaaagcaaagagaacataggtgttcaacaatgttgagttataagcaattaaaaacctaatgttaaaaaaagttgctcaatatcatattactattctatcgagtcttacttcctccaaagctaactgataagtacattacattcatccatgattagattgaattactcaaatgccttctatctctttattgtgattctggctttatttaaactgaaatgtcaatgttttctaggtatttttaccatttttgcagatattgggataatcactttcactaacggtcctccagaatttttagacatttctccaataagcatctatattaactaaactagcattaaataaagtgcaaacttaccttgtcataactatgcaattctgtattctctaaaggatgatttttcatattactcaacaattctgactgagcaattgaaattgagactatgataaatgttttacactgaaggctcatttcattatacagtagtcagttgaaatggggtttccgaagaaggtatttttaggaagtgcagagtacaggaaaaagctgaatacgttatacaatttaaatatttattgaagcttttctactaaggcaacattttggtaatattcacagaaatagcaatatgggaggaaattaggggtaaatagatggtagagactgtggaaaccaagacacctaatgctaaaagtgggatcctcattcatgaagtcattaaattggagatcgaaaggaacagacctctttatggaaatattattttccttagaatttcatcattttttctagatgtgtcttctctgattttttttttttagtgcttttgtcttctttattgaatttccgatctcctcttcacactctattatctttctagctggtctcatccactccatgagttgcatatttaaatccctaataatgacttcatttctaggcacaatacccacgcgctacataaaaatacaaaacaaaacaaacaccttagcatccacacccctaatccttcctgttgttccaatttcccttccaatctccttgcaaatggcaccattatccacccaggtgtgcatttcatggagcacacagcatgcaatacaacaccaattcctattgattctatctcatatacaaatcttgaatagatttacttctttcatctccactgtccccattctagtccaaatcaccttcttttggatgagctaccgtaattgcttcagattgatagtccttcatctaccctaggcacttgccaatctctttcacacaaaacagagtgatagtcttaaaaaatacaaatatgtttacatcagttttctacctgaaacccataaggctgtccattgatcttagtataaagagaaaaataatttctataaccttcaaggctctgaatgattggaccccagtcggccattcagatgcaagcttgttccacacttttctgccctcactgtactctaggaaagctgtacttgttttagatctttctccataccattttccacattcagaaacattgctccctctgacagggacatttttgctccctcttttcttttggacaactatactctaacctcattcttctttgccttgctttgaatattttttttttctcagaagtatttccccaatttcgaagactggtctaactctccctattatacattcttattacaatgtgtgctttattctatagcccttatctccaatgcaagtagtttgcgtgtgtgtgtatttaatatgcacatcctccttgaaatgctagtctctctttgagttcacttgtttagaatactatcgccagagcatagcacagtacctggcacaaaatgggcactcaatatgtgtatttgttacatggacaaatgaatcaataaatggataacaaatcatcagctgtaagtcccttctttaaactgtggtcacccaaaaccacacaatacaagttttagagagtcacttattttgatacttttatttttggatttattttgagagccaatccattttcagacatttaaagtaaaacactgcaaaagccataggcttgagcaaagtgaacctctgtgataacacttggtgctctctgacagcccattagagacggggtgtgtacacctaatccaaaggaatcctctagctcttcagcagctgttcacatggctcatgccctgcccttcagcgtctactaaatcaggattccccagctgtctgagcttcccgtaagcgattttagttaaccacctacaagccaacatttcttgcatctgattacgctctttaaagtctaatttcccttttgcttcctagttattttgcaacatgtgagtcattgggattcatcatttttacagattattattttttcacttactcaactagtttattaatattttgttcacttagtcaccaatttatttctaatacatcgttcttaagcaccaacataaaaaggaattactcaatttgcctttgatgaaaatacgtgggccattctgattttgtgatttttctttcttatttctttaatttttcctcacacagcttccaaggctaaaatctgcacttgtaacagtgtactgactcccttgccctttaagtcagcacttagctcaggctaaggtactattgcaaccgtaatctgataaaggaagagacaagttgagtgcaaataaagatgagtgccaggaatgagaaaaaagctactgatgtttatgcccttttatagtcctgattccatgacagtcttagccaaaagcagagtggaagaagggagaacgctttaaaacaaaacaaaacaaaagccaagaagagggtaaaaacatttaaagggtaagcattttatttgcccataattggaaataatatgggacaccgtaatggtaattgtgctcagctaacactgaccttttttaaaaatcaaaattttcatgatagtgaagacaacacatttaaaagttgacaaattagcaagagacttcgtgatatatatgtgaattcctcattgttgatatgcccatgtatggttttcatatttattaaatataaacaaaaaacatcatgattcgagcatctgattttttgaagtttctttaaaattatcttaatcctctccaaaacccattaagccatctacattctcatttcattacatggataagcattggctttaataatgcattttaatgtacctcctcttcgttgacacaaccacatttttctactaaaataaataactaaactaaaatgaataataaacaaaaataaaggcaaagctcttcctcagattcttttattcaaatggcaattagacctacatattattcaccagtcttagatatatttcagatttccaaattggcatgagaaaatcaattcatcaatttgctagcatttttaatttatggacaattattttcttaaaatggtatgtaatcaaaatactgagttaaaaattctgaaagagtcatttaagaacaacaacaaacaacaacagcaacaacattttatcagcatggcaaggaaatgacaactccatttcaattaaaggatcattgtccattctcccccagttcccattagtgaggaatggggttcataatgacagagtgaaagtgaggcattgagggagaaggcaaaagatcacaaaagaaagcaggaatacattgatttctaaaccaaatccagactactaagaacattggttttctcagggcttactatcattacatatactacgcaaagtcaccttcagaggttgtaggcctccagaaaattgctctgtgtgttccgttgcctactgaaattcccaagtattttgaacgagtgatatcagattaaaataaagatcgagctcagagttgaatagaaattatcccttaaaatggcagcctaaacagaagatgtgagctataaaagagggagtactgatctttgtgtttttaatgggaatgaggtagaggttgtatggccgtgagatgaggactctttttattttatttttttttaacttttaagttcagggctacaagtgcaggtttgttacataggtaaacttgtgccataggggtttgctgtacagattatttcatcacccaggtatcaagcctagtacccattagttgcttttcctgatcctcttcctcctccaaccctctaccctccgaaaggccccagggtgtgttgtttctctctatatgaggacacttttaagcataagacagcagagccatttcccttcctcattctcatttgtctgctgcctatcagaattgtgcttaagaaaatttatatgcccttaaaacgctggagccaaatgtatttttttggtctttttgttgggccatattcaaggaagtaatcttgaatggggaaacagaaaggctatgccctgggtgttaaagtatttcataatctctagaggagccatctggtttaagaaggcacattgaatgctataatatgctgtaatatatgagggaaacagactttttatactatcaagcctttcatgaaaaaatttcatgaaaaaataaacaaaatcattttagcttttaatcttggaactatatttagtataggagtgattcacaaatagcagagttactctcccattcgaaggggttatcagaatctctggaagacacattcacttttagtattaagtagagggagcttgaaattttgcaaggattttagggacaattctataagtgacataaatagaaaaaaccctccaaacttggtaaaataataaattatcccatggtgttgccattttaactttgatatctgtattaaaatgaaacttcagaactccaaacatatgtcaatattttatagcatgaaaccccaaggaagtctaactaatagatgttttacgtagggaaaaggtgaagactacaaactatttatttgcttggtttgtttgttttttgaagatcagtatactgcattgagcacactctacaaggggaaatattttcatgaaacctggttgcatttaataaaaacgtttatttcccacactgcagcccatgaccttccccagaaaatattccaatacgaaccaactgccttgataacagaacacaaacctcctaggactatagcaggactttgtgagaaagaaaaccattgcctctctctgaatccaatcaaaacctgaatgtactgtataaaaataaaccaaggtcatcattattccttgtcattgtgatttggcgtgccttcaaattatataccctgtatatttcaaataactgcaccgcctccattaactgagtttgacatcactttaatcaatgtatcttttcagaatgaaaggcagaaatgtcaaattcctaccattataaattcttttaactctctaatctgcattaaataaaaggttgtctttgagaaataataaatgctctaaagaaatataactagcatcaattttattttaaaatgtaactgggaaaagattaaatgtcaacacatctcttcatacagaggtgatttcccaagaaactattaaagccttacttacatgaggggcccctcccaaggctgtatccaattttctattatttttcttaaaatagcacccccaattgtataacctcaggccccataaatcctttcttcctggttcgttctgtgttgtcagacagggaatgtacattagtctcatttgtcaattccttaaaaaatgatgtgtgtttaaaatagaaaatttagaaaaatgaacagaaaattatctttaaagaaaggttaatttctaattagaccctcttaggaaactttataccctgtgatttgaatgcatataaatgtgcatatatataaatatatatactcataccaaaatactgtgtttcttgtatgtgtgatgaaataaagagttgatgaaaaagtatgataaatcatttttaataagttaggaaaatattacaatagaaggtggaaggagaaggaaagtttgggaaatgactttgttttactcttgagataaaattttgatgaaagataataaaatagaattttgaaaaacacctgatgtttccaagacaatgattttaatctcttttattaaactacacaagtggttaaaaacttgacaatttgtttcatatgtagcaaatgacatggagtacagggatttcaaatgaatgctataggaataaagaggaagctgtattaatatctgtgcccaaatgatgaatttgcaattcagtactgtctagctggaatagtgtcagccaacacctttttccccttaaataatgtaattatgcatagaacactttgtagtctttttttaaagtttagagtaacatctatatgacatactctattgtatttttcataatgttatgtcatgtaagatacaccaaaagctttgtattaacagtatatcatcaatttagatcagcaatctctttttcgtagttaagatgtctttaaaagattctgcagatgaaattctaaaaggtgattttattagacctcagatgacttacatcatttaaatatattcaaatgaaatgtctatttgcagtacactatttgaataattctttacaatgcattatttgagtaattctaaaagtgaacaatacaatatgtttgacaatacagtgatctcttttaaagggtaactgttttggttaaaaaacaacaaaacgtacttttgtaagtttatcaaactacggcaaatttacaaactggattcaaatgtcaaacatccaagtagcagtatgttgtcaaacagcaaaatttaatgtataatatagccctgagtatatctccgttttttcttaccaaactcattgtcatgttgcataggcattacttgatgattttttaaatgcagcgtgaaaaaatcctacagggcatgtcccaaaaagattacctttcttcgcattctaagaattgaaagttatttgaatatctatgacaaagcagagtgtagatttaccttgcttaatttcagcagaattgcatatattctttcaaaattgctctatatacttgtatatgatgttaattatgtagaatatatatatatataaaatcactagtgattttgatggtatttatgttacatatatcaaagaaataaaaacaaaaaataaaaatgtgtgtgtatattgcaaacaacagatatatgccatgcatatatttgtaatgatagtaaatataatagtttttcaatctaaaagtaataatgatgtccaccaaaagaaatttatgaagcaagccaacaatgtaagtaaatattgtattataaagtctggtagcttttaatgtgactcaatacatggacaatgttaacttatttccacaaagttttcccagtggcaaaacttctgcctttttttttagtagttgtggagcattacttatttggagagatttattttttcattcttaattataggcattgccctcatatctattttagaataactacactccacaagtcaaagatgggtggggaagagataaactcccatctcttcgggacacacagtccttatcatatattatttttactgttgtgccacagtccatttttaaatccttcattagtcatcatgactttcttaaaaataaacgaaatagttgtatttctatatgaaagacaaactaaaaaattgaactgaaaagctggctcataatagacatgaaacaacaaggtgactttactactaaatataattaggagttcctcaagtttgtatgtcgtttacccaagaaatcatctgatcatttgatagcatagatcacatcattatttgaaataattatcatgatatgctacagaaaagagcatttgaaatagtaaatgtgagtaagaaacattaaaattaaatctttatcaatacttttcacatccttcaattatccgtcccaactcattttattctttattttatccatgatgtgtcagagaaactttttctaacttttaggcctccatgtagttcctatacagtagttagttcaattgagaatatatgtcaggtcagtaacctttatgtaactgttactaaatacggaagtatcaactaatcaaaataataactcagatatacaaactatctcacagcaatcaaaataaatctgttatagtcaaatgacattctgcatattctattactgcagtggtttgttaatcaagaaatcatgtgtttagttctatcgcaaagaaaaacttttacactccatttctgttgaaaagttttcccaatgaaaaatatatattcctgaataaatacatatatatatgcagtatatataacatttatgcttctttgcaaactactgtgataatttaaaatcaatctacctaattagtgagcttgtcacaaactaaacgttatgccacagtaaaatatatttttagttactttgtacttacaacagtcctctacttcttcccaccaaagcattttgaaaagtgtatatcaaggcagcgataaaaaaaacctggtaaaagttcttcaaactttattgctccagtaggcttaaaaacaatgagaaaccaacaaacttcagcagctttaaaaaaagtaacacttcagtttttcctattcgtttttctccgaaggtaattgcctcccagatctgagtcctgtagggggaaagtgagtgatcccaacactgagtgagtcaacacagtaactgatgccaggattctgtagaggcccccggatatttcaaattccaggacctgcgcacaagcaagtgacccgccttctctctcaagttggtttcccataataggactgtccatggtcactacatataaggttgtgcttccagcatggcaagctctgtgaattcaaacaatgctcaactgtgttctgattaatatccaaaccagaatagcacagtggacatagtacttgcttttaaagccttctaaacacaaaaactattcagtacaaaagcataacaatactttctgtaactttcatgtgaatttattaacagagcagaaaatccggattcaaaattgacttttaaatgccttttttatcctctcaacaacaccaaaaatttcactctaccaaataaaaaggaatgcccagaataatccatgcatttgttatgtatccactgtctaccaaagttattttttccccttgggattcaatcaaaagttatgtattgatgatgccaacagtctgaataagagaagcagcagcagaatgcagcagctgaattctgaaggcagaatgtgtgtgtgtataggtctcatgggacatgttttcctgctaaaataaagaatactcttataatgcaggaaagaaatttttctcaaatcctaaatttcagttgtgaattatgctaaaacttctttactaacaaattattctttcttccatttctctggtgccaattcttaaaacaccatttttttagacattgagttaatgatcatttaatggttctgaatagaggcttgttttctgtattaagtgaatacagttgtattatgtcattcagcatgtaaatcattctttgccaatagaaagcttcttcatcttgttccttattacttttatgcaacaggcgagcccaaaattgatagaaaacattggaaacattttttaaagaaagatattctttttatagttataataatccctactaaaatttttgtttgagtgtttttattgtaccatttgttaaagtgacagactcatttttctatgtcaaacattcaactgcttgcgactgcaatgagtaatagataaaaattaaaaaaatattgagtcagactgtgatgtttaccttaatagttaattgtacattttgtgttttagaatattattgtcataacattgctattttccccagcaaaaggtgtatgagataaaacataaggcctaattttaatttaaaacattcttttccctaggtcacctcctttcctctcagtgtggttgtctaaatatgcatataagcaaaattttcataaaacaacatagaaaaaatgaaaaaattgttttggggctgatttggctctaagtctgcatgttagcatcagtgtccctctatgctgtgaggtacaatattgcccagagtataagtgccctttgtatcttgcactgtgagttttctacaaacataaacccttgtttaggccaaggcgtgaatacaacttgtcggtcccaaaccaacatcaatatcacgtgggaacttctgagaaatgcaagttgacacgagacctcaaaagtcagaaattctggggttgggacacagcactctgtgttttaccggtgattctaatgcatggtcaactttgagaaaccctaaagtgtatgtttctaaaaacaaccgtggttctaaatgtaacaaagatgtgtcctgggtaatgtctaaagcaccaaatcctgatagatctgaatgccctgagatacatttaattgccattcagccttagttgataatcagaatttatttggcacctataatgatttctgcattgtgtggaatgcatatacttcccttaagattttataatccaggtgcaaatatatgcttacaataactggaaaagtgaaaggcacgtaaaataaaatttagaccgaacaaattgaactccagttcagactgtgtcaccacagtactttcttgtgtcccttaatcacttatctttctcctttagtcctcagaataactacatcttgtaggtcttattagccccataataaaggaacttgctcaaatttccatttttaataactgtcacagaatttttaaaaatttattttaacttgttattttcaaatacttatagattcacaggaatttgcggggatagtatacagagatcccatgtacccttcacccagtttctcccaaagattaactacaataactacaattcagtatcctacaataactacaattcagtatcaaaaccaggaaactgacattgatatgtatacatatttctatttcatcactgatttgtgtaacctcaacctccacaaataaacacctgtttcatcaccacagagatttgcctcatgctacccctttacagtcacaacagtcaccctccctaaatatccctaaagcctggtaccaatcaatttgttctccatcactgtaattttgtcattttaagaatattagataaatgcaatgattcggtatgtaaccttttgagattggctttttttttttttttggcattctgtacttgagatccatttaagttgtcatcaatagcttatttccttttattgctgagtagtagttcatggcatggatgttctatagttactttattcacatactgtgggatattttcgttgtttccagggtttggtcactacaaataaagctgcaaaacaatcatgtagtttttcatttttcattcctctagattcatgtcccagagtgtggttataatttaccatataaattttagaataagtttatctacaaatagatctacagatctatctacagaatatctttcaggtagaattttgataggaattgcattaaaattatgaatacattttggaagaattgatgtttttaccgcattgattcctccaattcattaacatagtacatatgtccaatatttaggttatctttaatttatttcatcatactcggcttttttacacagtgctttgtgttgtgattagatatattaatatttctaatataatggcactactgtcggttatgcatgtgattgcacaaaaaaaggaaaacagcagagtttccaaaacccgttcttttcctgtttgtttttgctttttaagaaattttcatttaagagatggaggcttgctctgtcatccaggctggagtgtagcgacacaatcatacctcgttatagtctcaaactcctgggctcaagtgatcctcctgcctcaatcttctgagtagctgggtctacaggtgaatgccaccatattcagctaatttaatattttttttagagacagggtcttgttatgttgcgcaggctggtctttaacttctggcctcaagtaatcctcctgcctcagcctccccaggagctgggattataggcatgagccaccacactcggccagtttgtaaaaagaagcacatttaaaaatgtttacgttgttaaaaaatgttatatgcttgttggccgcttgtatgtcttctttcaagaagtgtctgttcaggccgggtgtgttagctcatgcctgtaattctattactttgagaagttgaggcaggcagatcgctttgagctcaggagttcaagaccagccagggcgacatggtgaaaccccatctctaaaaaaaatacagccgtgatgtcaggcgcctgtcatcacagccactcaggaggctgaggctggagaatcgcttgagcaggggaggtgaagtttgcagtgagccgagactgtgccactgcacttcagcctggactaagagcaagaccctatctcaaaaaaaaaaaaaaaagtgtctgttcatatactttgcccatttttaatgaatgtatttgtatttggtttgttgatttaagtttcttatagattctggatactaggcctttgtcagatgcatattttgtgaatattttctcccattcttcgtctgtttactttgttgatgtttcttttgctttgcagaagctctttggcttagtcaagttccacttgtcaatttttgtttttgttgcaatggcttttggggacttagtcataaattctttgccaagaccaatgtaaaaaagggtacttcctaggttttcttctaggattttttacagtatgaggtcttatatttaaacctttagttcaccgtcagttgatttttgtatataatgaaaagtagaggtccaatttcaatcttctgcatgtggccagccagttttcccagcaccatctattgaataggaagtcctttccccattgcttatttttgttgacttagtcaaagatcagatggttataggtgtgtcgctttgtttctgggttcactattctgttccattggtctatggtctgtttttgtaccagtaccatgctgtttgggttactgtaggcttatagtatagcttgaagtcaggtagtgtgatgcctcttgctttattcttttagcttaagattgctttggctctatgggctcttttggttccatacaaatttggattagtcttttctaatgaaaatgaaaaatgaaaattgacgttggtagtttgataagattagcactgaatctgtaaattgctttgggcagtatggccattttaacaatatttattcttccaatccaagagcatgaaatgttttgcatttatttgtgttgtctctgatttctttcagcagtgttttgtagttctccttgtatagttctttcacctccttggttagctgcatggtcatgaaaaagaatgaaatcatgtactttgcagcaagatgaatgcagctggaggccattatcctatgcaaattaacacaggaacagaaaaccaaataccgcatgttctcacttataaatgggagcaaaacactgagtacacagtggacataaagatgggaacaagagatactggggactactagagggggaatggagggaagcgggtgtgagctgaaaaactacctactgggtacaatgctcactacctgggtgactggatcatcagtaccccaaacctccacatcacacaatatgcccttgtaacaaactcctgaacatgtacccccgattcaaaatgaaagttgaaattattttgttaaaattttaatgaaattacaattgtttacagatgaattaattagacatacatttttcaaaaatataaagcataatttttattacagtgaactcatacacatttttttaaattacttttttttgtctacacttagatgatacatgttgtaaaatgaagactggcccatgattatattccaatattaaccagtcatccttgtgttattaaatagatggcatattaattagaaagaactgaatatggtaaacgtaaagtgaacaaggagttaattcttaaataattggaaaccctaaaggcattattttatattactttggaagtgcagggtcattttcccaacttgtttgattatttaatataattccaagcattatgattaatgcagcttcacaggacaaataagttgaagagaaacaggcttattaggtaatatacttatataaaattcacaaatttattgattagggaaaaaatcattatggatcatttctacttcctttttccacagtgatccatattggttgaaatgttacccatattataaggcatatatttcttaggtgtttaaaaaatctctttagttaagtccaatgggaaaatatgctagtttgtgagtgagtttataggcactaggaccagaaaaaataagacaaatagaattcaagcaatttggagggtgtccaaatagacaaaaatgtttcactgatgttttgataggaattgcattcaaactatagattagttttggaagaattgatatatttactatgttgtatcctccaattccattaatacagtatatatctccgtttatttaagtctttgcattatttccttagctttttagtttgtagtatatagatctggtaaatgttttattagattcataagtatttcattgtttcagagtgactgcaagatactatgtgaaaaattttgggtttcagtagttaattgcttgtatacaaaaatacaattaatttttaataatcattttactgtgataagatttaatatgagatctacccaacgaacagattcttaaattataatgctgtattgttacatatagatacgatgttgtacagcagatctctagaacttattcatcttatataaatgaaacttcatattcattgattagcaattgacttttataagttgatcttgtatcctaagaccttaacaaactcatcatttctaagagtaactttgtagaatacctgggattttacatagatcatcataacatctgcaaatggagacagtataacttttccttcctgatttgtacgcttttatccacttttcttgcatttttacactagctagaacttccagtactatgaataatagtagggctgaaagcaaccgtctttgccttaatcctaatattaggaagaaaggtgtaaattctttcattattattacaatgttagctataagatttctgtagttattcttttccaagttgaggacgttctcctccattgttagttttctgagagcttttatcataaatggggcactgaattttgtcaaacgttttttcccctccatcaattgatatgatcaagtgattattcttctttagcttcttaatataatgtgtaaaaatttgttaaggctttttgtctctatatccatgagttttattggtctgtaatttgttgactcttctactgtgcttacctggttttattatcaaaatacttcttcctcataaagtacatttggaagtgttgcctcctcttctattttctggaagttgacagttctctcctttcatcacttgaaaaatgtcatacttcttccttcgggctttcatggtttcacataagaaatcctctgccatttgaacttttttgcctatagataaagtgtctttttctctttcactgtttttaagactttttttaaaaaaaaaatataactagttttcagacatttgactatgatgcgtctaagcatgagtttctttgggtttatcctgtatactcagctccttgaatctgtagggttttgcattttacaaaatttggtatttttcaatcattatgtgcttgagtacttgttcaacaacaccctccctttttgaaactctgatggcataaaccgtagatcttttattataatcccataggacaactgagaatattttcattttaaaaatcgtttttttccttcttgttacgactgtgtaatttctattgtcctatctttctgcacacagatttcccctgtctcctcacctccattctactgttgagaccatttattgaacttttttttgattacgatatttttagttctaaaatgtcatgtcgttctatgtcttctatttctttctgacttttcccattttttatttgttgcaaaatgttttaaaaagcttactcaacaattttcgggatggctactttaatatccttgctagataattctgtcatctttgtcatgtcagtataagtgactactatctttttgcattccagttgagattttcttttttggcatttgggatattacattatcagactctggatcttatttaaatctattttagctcgtccccttctgactgttctggtggaagatagaggtagaagtgtgctgccttattgccaggtgggagtgaaggtcctggttccccactccatctatggttgatactttagagattattgtgtgtgtgtgtgtgtgtgtgtgtgtgtgtgtgtgtgtgtgtgtgtgttctgtaaataaattttacttgacaccatcttaattccctttaaaattagtaagtagatatctggaaccttgtgagttcatttttaaatgttcagatttttttttccactggacaaaaaaaaaaaaagagctttaactcacatttccatagacaatgaagcccatggcattcacataacgatgtgatttcaggacttggtactacatatcagtactatctatagagtcaagaaagaaaacatttgcttaccaaatataagcaaaactcaaaactaatttgcctgtgttgtgaaaataatgactcctcactttgtggattgattcccaactgttttatgaggtaaatgtacagggattaatgaagatttttaaagatttctgaatgtaagaaaggtattatgagtacaaagatagtaaatgcattgatgctagtgagctgagaatcagtaacatgttttaatagttgtatctcttatggggtattagtgaagatcctggtaggaaatataggtagcagattcaaaagcatttaacagataataattcggtgaaagaactatggacaaacatataggcaggctgatgagaacaaataagggatggtgagtcacctagcaagcagcaagagaggtaatttgtttctacctccaggcctaatatgtcaaggtaaaggaataatgttggaatagcaatagaaaagggcagtcactaccaggaccttagtgaggcatatgtgaagtggaacacaaatatccaaacctttttttcccttgccctctgatgtccagctggtgtcacataatttcctaaaagttagtgcacaagaggcgttggtgatacaaatgaagagacaagctttccagggcaaaaaacagggcagagaattgcaaaatgggtgtggtagcgaggagtggagccactgccactaatacaactgaagaatttttagcaagcaggctcacccctaccatttcagtcttggatggatactcagtactagtgtgataccttgtagaaaatatgatcaaggatgaatagatcctacgcaatgtagcctttgccttcattttcaaccctacatctctgaacttccttgagttatgttatgtgctttcctactattatatctcagattatttaaaaaattcatcatacatgttttctgagcatgcagctttactccctttttgcatgtgtgataaataaattgggtgtatgtttaaggtgtttcttacctgatggaaggcaagctccatcaaaacagttgtgtcttcctttttagttgctttatcactattgcttgtcattttgttgtgtgaataaaattgtctccacttgcaatttctttgtattatatcctttgtgtattatatgctccctcattcttctgggctttgtttaaatttactttatgaagattattttttttagcttctcctcactcccactcatagatgggtctaacaatatgaatgcatctttactactcagctgtaaacttcttgatattaagaattaattgctatttatattatgttgataactttagctctcaaaagcacattgggtgtaataggagtttagtgatatcagttggaaaaaaggaaacaggcaagagagggaaataaagaaatttatgatccagatcatcataaaatttaaaataaactttgaatgtttgagagtagcaaaccaaatctctttgagagtgtatgctaaaagaaattatgaaccttggtactatgggatgaccatagtgacaaattctcatttaaaacaatggaactgggccgtggaataaatgtgtatttatttatgaaacatttattagggccagattttctgcattaaagatatgagctaacaacttcaggtccctgccctcaaatagattataccttgggtatattaaaagaaaagttgacattttaatcgacctgctaattgataaacttcaataagcttgaagactttcgtctcagagaggtacctaatagcaagaccaggttttaaagataacaccgtatgcactgcctactataaaatattgtcatttaggttaaattaagcattgcgttttaaaaagctgctcccaaacgcatacactagacaagatgaaaagtctcagatcaataatcaaagttctcatctcaagaagaaaataataaagagtaaaaactaatcaaaataaaaacagaaaaacagtaaagaagattcattaacaaagagctattttttcaaaacggtcaataaaattgacaatgtgctaaaagtgacaaagaaaaaattgagaggacacaagttacccgtatcagaaatgaagtagggaatattactacaggcctggaaaatacaaagaaaaaaaaagacagtaagggtttactatgaacaattcttcacataagtatttaataatttagatgaaatagattgattcttcaaaaggcacaaactactgtaaatcaatgaatataaaatggataatttgaatggcctagactttggctatttaatagtaatttggatatactagataatgagtataactgttaaggaaatataactcataatttaaaaacttctacaaaagcaaacttctataactgcattggaaaagtatgccaatcttgtgaagaattaacaccaattctacacattcttttccagaacatggaagggaagaaaacaattctgagtatatgtgttgagtccagcaatagcctgatacccaaaccagaaaaacagtacaaaagaagaaaactataaatccatattccttacaaatattaatggaaaatttattaatacaatttcagcacataaaattcagcaatgtactaatggatcacttggggtttatttccaggatgtaaatctggcttgatatttgaaaattagtcactacaatctaccatattaacaggtcatagaggaaaaatcacacgatgttatcagtaaatgtactaaaagcatttgacaaactgatatatctaatcttgaaacaacctgtctgaaaaataggactaaaggagaatttcctcaacttaataaacaacatctacataaacctacagctaacttcatacttaatagtgaagtattaaatgctttccccttaatattgtgaacaaggcgtgaatgcacacgctcaccactcttattcacgtactgctacaagttctagccagtgcaatgaggcaagacaattaaatcaatccatacagatgggaaaggaagacataaaattgtcccttatatgtagatggcatgaaaataaaattttcaagctatctataaataatctcctagaaattattgataagtgaattcatcaaggtagcaggatgcaagataaatatacaaaaattgattgtaaccatttacattagcacctcccacaaatgaaattcttagatctaaaactagcaaaatacataccatatctatatgaggaaaactgcaaccctctgatgaaagaaatcatagaagataatccatattcatggatgggaaggctcaatatttttattatgtcagttattctcaaattgatctatagactcaatgtaatcccaatcaaaatctcagtagttactttgcagatattaacaaagagattctaaaaatgatatggaaaggcaagaaaccttgaatagccaaaacaacattgaagggctgggcgtggtggctcacacctgtaatcccagcactttgggaggccaaggtgggcagatcacttgaggtcaggagtatgagaccagcctggccaacatcatgaagccccgtctgtactaaaaacaacaaaaattagctgggagtggtggcacacgcctgtaatcccagctacttgagaggctgaaatgaaagaatcgcttgaacccaggaggcggagattgcagtgagccgagatcatgccattgcactccagcctgggtgacagagagagggagactccatctcaaacaaacaaacaaacaaacaaaaacaatattgaaggacaagcacaaagtcagaagattgagactgctctacttcaagacttcggtaatcaagacagtgtcttattggcaaaagaagagatcaatggaacagaatagagagcccaggaataaacccacataaatatagtcaactgactgatgtttgataacggagcaaagacaaccttttcaataaatggtgctggaacaactgggcatccacatgcaaacacctttcacaaacattaactcaaaatggatcagaaacttaaatgtaaaatgcaaaactataaagcccacagaagataacataggagaaaatctatatgggtctggtgatgactttttagatataacaccaaagacatgacctatgcaagaaataattgataagcaggacttcattaatattgaaaaattctatgctgcaaaagacattgtcaaaagaatgtaaagacaagccacagaataggagagaatatttgcaaaagacatatcaggtaatggactgttatccaaaatatacaaagaactgttaaaaatcaacaataagaaaacaaacaactctattttaaaaatgggcaaaacaccttaacagataactcaccaaagaagatatacagatggaaaacaggcgtatgaaaagacgcttcacatcatatgtcatcaggaaattgcaaattaaaacaacaatgtgatgctactacatacctcttagaatggtcaacactcagaacagtgacaccacccaatgctggtgaggatatggagtaataggaactcttgttcattgcttgtgagaatgtaaacttgtacaaccactgaaaatcagtttaaggattttttacaaaactaaacatactcttgctatatgatcaagtaattagactctttggtatttacccaaataagctgaaaacttatgtccgcacaaaaacctgcagatggatgtttatagcagctttattcataattgcctgaacttggaaacaacaagatgttcttcagtaggtgaatggataaataaactggtacattcagactatagatgctaaaaagaaatgagctatcaagacatgaaaatacactaaggaaacttaaatgcctgtttctaactgaaggaagccaatctgaaaatgcttctatatactgtaggattccaactatatgacatccaggaaaggtaaaattatgaagatagtaaaaatatcagtggttgccaggggttagttggcagggaggcatgactaggcagagcacaaatattttaggtcagtgaaactactctgtatgatattatcatagtagatacacatcactataaatttgtccaaacacacagaaaacacaacaacaagagtaaactctaatggaacctatggatctgagttataatgatgtgttgacgtaggttcatttattgtaacgaatgtaccactctggtgagagttattaataatgacagaggccatgctcgtgcgggcacaatgggtagatgggaaatctctgtctttcaattttgctgtgaacctaaaggttctccaaaaataaagtctattaacaatcacttgcattctgtgaattaataatgaacatatggacatggaaatttaaaatatagtatattttactatgtcacaaaaattaaatataaatctaacaagccatgtacttacatggtgaaagcaaaaaaaagttttagaagtaaatcatagaacatctaaattaatgaagaaatatattgtgctcgtggattgagagattcaacacagtaatgtcaattttacccaaactgttacacagtttacacaatttttatcaaaatctcagcaatatttttggaatttaggtgtaggaaaaatttatgtgaaaaggcactctaaaatttatgtgaaaaggcaatggatttagaatagctaaaacaatgttgaaaaggaagaatgaagtaagaggaataagtctaccagactgaagacttattaaatagctacagtaatcaagatagtgtggtgttggtgttgggatagacacgcagattaatggaacagaatagagacttcagaaatagacccacacaaattgctcaactgattttgacacagtgcaaaataattcagtggagcaaagatagtcttttcaacacatgggtcttagaacaagtggacaaaaataatggaaagaaaaaagaagaaaaagaaccttgacataactttacaccttatgcaaaataaaatgcaaatagatgatgaatttaaatgtgaaacacaaaataataaatattttacaaaaacatacaggagagtcttcaggatgaaaggctaggaggagttcttagatttgacgttaaaatcgtgtgccttaaaagacacaatttgataaatttgacatacaaaattttaaaattttgctctgagaaagatgctgccaagaggatgaagagacaggctgcacatcgagaaaaatacctgcaaaccatatatctgaccatgcactagtatctagactaaatgaagaattcatgtaacccaaaagtaaaaacaaaatagacacaaaaaaatccattagaaaaatgggcaaaagacatggagacatttcaccaaagacaacacatagatggcggataagcttgtgaaaagatgttcagcatcattggctcttagggaaattcgaattaaaacctcaatacgatataactctgtgcatattagaatggctaagttaaaaaatagtgacaacatcaaacactggcaagaatgcagagaaatgagatcacttacacattgttggtggaaacatgagatggtaaaggtactctgtaaaagtttggtgcattgtaaaaaactaaacatacaactaacctacagcccagaaatttcattccatggcattaatcccagataaatgaaaatttgctcataaaaaaactgtacatgagtcttcatagcagctgtatttgtaataggcagaaactggaaacaacccagatgtccttcaacaggcaaatggttaatcaaactggcatattcataccatggaatactactcagcagtacaaaggaacacattgttgatgcacattacaaatctggaagaatctccagagaattatgctgagtgaacaaggctagtcctaaatagctacataatacagggtttcatttacataacacttttgagatgataaaattatacaaatagagatcatattagtagttgctagagattaaggagtgcctgagggcaggaaaaaagtgggtctgaccatgaaagggcaacatgagtgatccttgtggtgatggaaatatcctgtattttatctgtgctgatgtcaatatcttgttgtaatattgttctatagttctgtgactttaccttaaggagggactgggtaaaatggcacacaggatctttctgtattatttcttacaactgcatgtgaatttacagttatctatctatcttttttttttaaaagacagtgggctgggtttagcctatgagccaaagtttacagactcctgccatacgacactgacattcgtgcatacaaataaatataagataaaactacattgtgaagcctgatggagattaggtggcatcaatgtcatgtttaacactgttgcacttgcttttttttgttaaaaggatactgcaactagattatataacgtaacacacttaaaagaattatctaattcaggaaaattttaaatatgcaaatcagaattctgggtatcgtttaaataaaatatttagagtcttgtaaaaacaggctctcagtgccattgtgttattgttaatactcaaaactgtttcataagtttatttattgaaagcctagaccaagttattactacacaagaaagagtaaagaaaacaatataaatctatgtggatgacattttagagtgcaacttcagcaaacttgtaggctcaaattaaaatcctttcctaatttctttctttaaaaaagcaaaagaaaaaaatcccctccctgttagaattatttttttactctgttcttaaaaccaccatttttttccatggcaaggctaagttttcatcctgataaggtttttctgaaggtttaatgtgtcatcctaagaaacaattggtaagaattgataagaacagaagatccaacgattgcggtgcctaaagctcgaggctattcttagttgtgcatatttttcgagcacgtgattatatgaaagttctgcacatatttttgaagacttctatgaaataaaggggcccaaaagcttaagcttcatttgcttcctgacaactcaaatcatctggaaaggagagaagctttgagaggatttatgtagcagatgaagctgcacatgctattttctctaatagtttttaaagagagagagagagagagagagagtctttgagtggcatcctgttttgaatacctcactacagaatgccttaaaaagaaatggaaagaaaacacaaataaacaccatttataatttggttcaaaattttctgagccccacaatgaatatacttactcactgaagcctgagagtcagagcctgttaatggaaatcagagaaaatatttgattcgaatttaaatgaggtttcacaaatggattgaatttagaggaggataaaaaaagttttatattggtttatgtctcaaaattctgttcagttttataaaatgtttaaacattgtgaagtctggttatttgaaagatagcttttaatctatagtatattaaagattagtgcttaaagtatattctgggtttaatagatgtctaaacaacctaaacaacctaaagcatttatatttccttaaacatttttaaaatattgaaaatcttatggtgaatctttagagttaactttatttggaatattgagaagtatgatgttattgaacccaagtttaatatgttattgaacccaagtttaagtgtgtgtgtgtgtgtgtgtgtgtgtgtgtgtgtaggcatatgctttttccatcacaaattatcttccaaggtacatgtctctctctccacgttagcaaatgaggtacatttaagggttttcatattctgaggtaataccttcaggaacttggagaagagagtaagattagaaatagtttaaaatctctatatttaaaataaaaaggggagggacttggagaagggctacttcgataaaacctcagtatgaaaacggggaaatctgagagtacaattggctcctagaaggttggttagcaaaaatataatacatttttaaatagaagcaatgataagagcagcagttaaatacattagaaaagataaagtatattaggctatcaggctctcacttccacctatattccccatttaaaaaaatttttcttcagctttttttttttttgagacagggtctcactctgttgcccaggctggagtggtaaacatacacagtgtttgtttatttttaacaaactgccaaactattttccagactgatattcttttcagtaatgtacgagtgatcccatttctccacatttttgctagttatttggtggtagtgtcactattttttatttcagacactctgaaaaatgtgtagttttatctcactgtggtttcaatttatatttgcttgatgtctagtgatatttaatatcttttccatatgtttgtcatttatatatactattcagtaaaatgtctcttcgtgcctttggctcatttcctaattaatttatttttggatttttgcttttgagttttctaagttcttcgtatatagtccctgtttttgcaactgatatgcaaatattttctcccattctgtaccttgtatttcacttcttaagaggatccttttcagatcaaaagttttaattttaacgaagtccaatttatcagtttttcttttttatggattgtgctatttgtgtaaagtgtaaaaagtctttgcctcagtcacaaaattttctcccatatgtttttctaaaatatttgtagttttatgttttatatttgacatttgagataattttgcataagacttaagttgaggctctatttatttacttatatatttatgggtgggctttgtttgttttgcctttagatgtctacttgctcaaacaccactcacttagaaaaaacgcacactatttgttgaaaaggctatagaaatggaaaggctgttaaaattcctccttggaattgctttcacaactttttaaaaaatgagtttgcacatatttgtgcgggtctatttctggaatctctattctattgcattgaactatgcgtctatctctcccccaattccacactgtcttgattactgtagctacataataagccttaatatttagtggagtgattctttccactttattcttctttgtcaagattgtattagctattatcaggcttgtacttttccgtataaatttagaataagctgatccaagtctactaaaaagaccttgctggtattttagtagaaatggcattaaaactatagattaatttggagataattgacatctttaccatgttgagtattccaatccattagcagagtatatctctccatttataagttaattttttatcatgctgtgtttttcaacagtgttttgcattgagattagactgtgttttcatatttctaatatacttacaatgtgctattgtctgctatgcatgtgattacacaaagattgcgaacatagcaaaaggtctaaaattatgatttagaaaagaaagcagattttaaaaacctaaacgactatagctaaatatacaccatatgtgtatgatgttgaaataattttaagtaataagattataattgtttatagagggattgatagagacctgtaatttttcatgaatgcaaaatatattttaattacattaaagtcatgcatcagagtgttttttaattacttttctttagcctacagttttatgatacatgttgtaaaatgaagactggtccttgcttatattgcagtattaacctgtatcataaaacagatgacaaactcttagaactaagagcactaaatttaaaagtgaacaagaaatgaattcttaagtatcttaaaaccctaaaggcatttttaaaaataaatatatattttatttcatcatacattgtggatgtagagtcattggtgagaaatatatcccctgcattataacaatataattattggaaagtataatattcttttaatatctaattcaacatggaataatagattttcagcaaaaggagggagttgcatatatctgacctttattgacaggcctttttgtctccagtaattacccaatctctatgcgattcagtgttcttaaggaaatccaacttttcttgctcttaattatttgtttccacaaaatactagccaaacacatagctattaggtctatgtgaggtggacgtatacatcaaaatttcttcacagccacttaaccaacgtgctaagttttccagaatccaaaacaaatcagtttaagaggtaggtatgcaaagaccctgtaatactctagattttaaaaaagtatccttagttaagtaccatgagaaaatgagctagtttatgtgctatgttaggaacataatagccaaaaaaaaaaaaaaataaataacagttggaatcaggcaccttggtacttcatgagtattttgcaacagtataatagggcctttcagtaatgatgtgcttgcatagaaatacatgaaaattacacaaatttgatatttttagtaactgaatttagtttagttttgtaaactcagaactcaagggtgacgtgcatatgtgcgtggagtgacttacacatacatacacaagcaatcatatgtacaacttgggctcttagaaagtagggcacattgtcaccagttgaattgtcatatgattcctgatttaaatgataagtcgttccaatttcttcaacccttacttcttgagcgaacagtccatatgcaaatcagtatggagtggcaaactttaatctcacgttctagtgagtattttatactaaaaaccaccagatagagtcatgaaaagtagaaattgtttatatatacacaaacgcattttcttaaagtaactatgagtttcatttactttcatcttatactttgttacttcaaagggagaagttactgatttttcttatctccctttatcagccatgtccctggcaagaaatagaattcaacatggatggttcaataaaacagtacaaaggaactactttcagaggtgtgaatgggcttaaagaaaccaaaaggggctatcgaggcacctagagacaacctccagtaggcaattgtgatatacctttcccagccttaccatgcctgaagagtcaagtgaaggaagtaggattttctaaatccagtaagagatagagccatagaggagattcttaacaggatagttagagatataagctgccatggtgggaaataaggcacaaagagagtggaggtcaatgtaaaaggaatgtcccagatctgctctctttctgcctttctgtcttatgtttatgccttccattggccaaaaccaacaggagactactcggcaagggagctaaggaaatgcaatttataggggtcagcttcacagtgacagagcagaacaaaaaagagcataaaatggattgggccaagccagcaagaaaagagtgtactgaaatatttaaaatttagagagaaaaaataaatccaccaacctaaaatgctgtattggtgaaattatccttcaaaagtaaaagagaaatgaatactttatcagacaaacacgctgagggaatttgctgccagtagatctgccttgcaagaaatgtcaaaagaaggacttcagagaaaaagaaaatgatgtaagtcagaaacttagatctacataaagaaaggaagtacattagagaaggaaaaaatgaaagtaaaacaaaattatctattcttcctattcctgattgatctaataaatatttgttcaatataataacagcaagaagaaacattggatgattagagcttatggataagagaaacgaatgccagtaatgttacaaaggttcaagaaggaagagttgggaatattctgtgtgggaaaaaacggattggagtgggagcagaaaaacaaaaatcacaattcctttacgtaaattaacatcagaaccatcctctaattaggagttcaagttcaacttcacttggttgtaatcataatttcaattctttctcttcttaaaagctaaaggagccaggtgcggagtctcacacctgtaatcctagcactttgggaggccgagaggggcagatcacttgaggtcaggagtttgagaccagcatggtcaacatgttgaaaccccttctctactaaaaatacaaaaaattagccgagcatggtggcgggcgcctgcagtcccagctactcaagagactgaggcatgagaatcgcttaaacccagcaggtggaggctgcattttaattatttattcatctgatgatggacagaatctaaaaaagttgaactcatagaaatacagattagaatgaagattaccacagaaatggcggaagggtcctaccgggaaaagaaagatgttgatcaaagggtacgaatttttagttaggtaggaggaagaagctttagtgatctattgtacatgatggtgactataatatatcataatgcatcatatatttcaaaattgctgaaatagtggattttaatattttcaccacaaaaaaaatatgaggtaacagattcattaacctgatttaatcactctgcattgtaagcatatatcaaagcaccatattgtaacctataaatacaaacaaatattaattgtcaatgaaaaagaaatttaaaaataaacgacaacatcaatacgacatatgagactaccattatagtccaaaaagtgcactcctgggcatttatcccagagaaatgaagacttatgttcacacaaatcctgtacattagggttcacagcaattttattagtaacagccccacactgtaaacaacaatatctctcagtcagtgaatggtgaaactgtaggatgtccacaaccataaataaatcagcaacatatattagtaataaaaagtaacaaactattgcaatatgcaacaatttagatggatcattaagcaattatgctggctgaaaaaagctagttcgaaaggattaaataccatacaattctatttgcataatattcttgaaatgacaaaattatagacatgaagaacagattaatggttgccacatgttaggcatgggacagggtgacaagaggaagcttgatgattttattaaaggtcaacaggagagatctttgtggtcatgtaacatccgtattttgactgtcgtggtggacgcactaatctacatgtgtaaaaattgcatttaactaaatatatacacacacatgagtataggtaaaactgggaaaatctgaattagagaggttaattgtaacaaaatcctcattataatgtttgaatataatttgcaagatattacaattggggataaccgagcaaaagccacacaggatatttcacataggatcttttatattattttttacaactgttcttaactctacaactctttgaaaataaaatgtttaacttttaaaaagtttctcaagcttgcttagcttgtgtcagagcttggattccaatgcagatatgaagccagagcccttgcttcctgtcattgctctataccggtcctcagagttcccaggacgcaggaaggtagattggaattgcactgcaggcacaatttaaccaccataacagatatcctaaattatttttttatttttaatttttgtgagtacacaatagatgtacatatttagcggtacataaattctaagctaccaatagattttagatcatatggtcttgtaaaatagtatgagcatgcaacggttaggatcatgctgccaacctctaccacttaatagatgggtgtgtgtgtgtgtttgtgtgtgcgtctatgtgtgtgtgtgtctgtgtgtatttgtgaatgtgtgacaccttggagaagaaaatttttcacacctcagtttccccaattgttaaatgagggataacaactgttgctaactcactgagttacaaatgacttaatatcgacaatgcacttagaataccacccagaacatactaagttgtatgtgttagatattattattactactactgattgcagaaatgataaaatatgaaaaatgttcttttagaagaaatgtggcaaacacactgacatgattcaatgaacagcagtctagattatgtatattgtcttataattttatcatctacgtgacctaagtattagccaccgctgccattccaagagtcgattttttgtaaaattctgggaaaagagattttgcttctcacatttactcctaagtcagaagtctattgggtaatcacttctctgggtttagatccctcctggccactctcagtgattctttcgcccaggccactgttcgctaagcttgtcaccacatggatttactggacaattgtccatttactggacaatggctcttcctagtgtgctgctgcccctcagcatgggcttcagccccacaccaaacatggaacaggctctcctcctgttactactcacccttatagtccccacaactccatcagagagttctgtaggaatactggcctttactggagggttgggattgggggtaactaagagaattacgttaagggatggagaaaggccaaactctatactaacaatggcttggtcttgtgttgtgtagcagaaaagcaggaaaaaattaacccctacacaacgttttttgtgagcacgcaccagttcctattcttactctttcctattgaaggctatgggcttcctttctaaaaggcctccattttcaagctagaaatgactgccttccttcagggaaattccaccccataataggaaacattgatcatttactatatgccaagtattgatctaagcaactcatcagaattaactactgtatttaattgattctgagatgacatttcacattttaacatttctaaaatcaatatgtcttaaaatcattagtgtatagcgtttaggggtatcctgttttttaatttgttagtcctacacacaacaatggtctatcttgcaatttattatttcttagattcaatgacatacagcaatatagttttcacaacagtttaatcatttagggacttattttatcaacattttatagatgtcacaatcgagtctcagaggtgatacacacctagcaacctcaaggttgctcaaggtcacacagctagtcaatggtagatttaatcccagatagcctgatccaagagcctgtacccttagaatataatctgctcctcccagattagcgccatctcccatgggtccccattaattagcaaggacagcctaatctaattcatagtgaggaagagaaacattttccaaagtttgcaaaacttgccaagctggccaacttatattattattattattattatttttttttttttttatgagacggaatctggctcagtcgtccaggctggagtgcagtggcgcgatctcggctcactgcaagctccgcctcccgggttcatgccattctcctgcctctgcctcctgagtagctgggaccacaggcacctgccaccacgcccggctaatttttttgtatttttagtagagatggggtttcaccttgttagccaggatggtctcgatctcatgacctcgtgatccgcccgcctcggcctcccaaagtgctgggattacaggtgtgagccactgcgcctgtccgttatagtattaagcaaaacgagtgccaatatttggcttctccttcctttttttttttctttttttttgacaaagtttccctcttgtcacctaggctggagtgcaatggcgcgatctcggctcactgcaacctcagccttccaggttctagtgattctcctgcctcagcctctcaagtagctgggattacaggcatgcaccaccacacccagctaattgttgtatttttagtacagatggggtttcaccatgttggccaggctggtcttgaactcctgatctcaagtgacccacccaacttggcctcccaaacttctgggattacaggtgtgagccaccgcgtccggactctccttcctctttcaagttgtttcctgggtgtggggtgtggtggggaacagaggcgtaaatagcaggtcctttacagaaccacctaccacaaagatgactacactttgcctacacaaaaagctggcagaagctttttgctttattttggaggccttatcaaacaccagggcagaatgatctgtaatctctgaggtgagaagctagtgaggattaaccacttttctctcctagcaaaaactcccaaatggtgaggctagtggggaaggaccgggtggtagtgttattgttcttccagttacatgtatttgtaatattattcaatgtaccttatctattaattatgtatattttatcagctcattccccatccaactgtgacagagggaagtgtgacacaagaagtagtgattaaatatctcaacatgttcatgcatccagcgagcaaaaacccagactactttgaagtaaggatagactatgtcagccccattaccaaatatttgagggaaacggttgtacaatataaaaccatttctgaattttagaggagtcaaatataaggtttccaaataatataaaacgcacgccattggtttcctccctccctccctccccttcctccctccttccctcccttcctcccttccttccctccctccctccctctttctttttctttctctcttttttttttgaaatggagtttcactcttgttgcccaggctggagtacaatggcgcgatctcggctcactgcaacctgtgccttccaggttcaagcgattcttctgcctcagcctcccaagtagctgagattacaggcgtgtgccaccacgcccggctaattttgtatttttttagtagagacagagtttcaccatgttggtcaggctggacttgaactcctgacctcaagtgatccactcaccttggcttcccaaaatgctgggattacaggcacgagccacagtgccccgccagttatctttctttggctacacctttttgaggtaggactttcataccactgggcaatagcaactgaatataggaatgaacttaatatttctcatacatgaagattatggcatttcatttctatttgtgaagtgggcacggatatattaaaaatatagaaaaccttactgttctcatttaaaattttttcacgatatacatcacatttcatacaaaatgaaaatatgtattgctcgattttgatatatcttgtacttgattgtcaattaaaatgaattaatttttgtattgaaaaatttagtaataaaaactgagaatgtgaactacacacccatatacgtgcacaacaaaagcttaacatggtatctataataagcctacagagttcttttaaactaaacataatagttgccaaaagggattcatagcttttgaattgatttaaaattaacctccctgtcacttccaaatgaatttccatttatgtaacataaaattgtcccatgacaaaactttcagccggaatacatttattccttcttgagtctatcatttgcaaagcactatggtgtgccacttggaaagggatctaaattagaatttttcccaaaagccataaccaggtatatgacatgcagcattttaaagggtactcttgaattcattttgatgcctgtactcacttgagcacatatgttttacaactttgaagacctccctctcttagctgggttctagctcacacaatgctccagcattgaagatgttgaaaaaagatgtgtctgaatattcacacacacacaagtgataatacctacataatactgggttgatggtttattaaaacacaagaagcatctaaactgccccacaaatatcatgcatatttagaaataccagattcattttgcatatcttgtggattccttatacagcaccctctctcccccctgtttgtgtgtgtatgtgtgtgtgtgttaatgtgtgtgtctgtgtgtagatgtgtagaaggaatctagtatttctaaattcacatgataattgtggggcattttagatgctttttgtgattgaataaaccattaacacagtattgtgtaagtagaattattcacattttgcagataagaaaactgagatttagtaagttttttgtccaaagctataaccgagattttaaagtcctgtgacgttaaaccctaaaacatatgcttttagtatcataatctttaccatggttaccagatgacatgttaaaaatctgctaagtaaaggataggacaccaataacccaaattattaaatgctatctaggtttaagtgagggcttccatcaatactgagaaaactttgcctgcatgcacccttgctacttaccaattaacagcatcgccgttatatatgagcttgttaagtaagatgttgaatactggccgggtgtggtggctcacacttgtaatcccagaactttgggaggctgagggggttagatcacttgaggtcaggagttcgagaccagcctggccaacatggtgaaacaccgtctctactaaaaatacaaaaattagctgggtgtggtggtgggcgcctgtaatcccagctactctgggggctgaggcaggagaatcacttgaaccccggaggtggaggttgcagtgagccgagatcccaccactgcactccagccaccactgaactccagcctgggtgacagagcaagactctgtctccaaaaaaaaaaaaaaaaaaaaaaaaaaatgtcgaatgtcaggcacattccaaacctactgaaacagactctaaaatttaacaagaaccccagattatttagacacagttatgtatgcaacagctatattctacaggtgtaacaagaaacaaagctaaggaccaatctaaacatttcctaaggaaaaaaaaggagggcaatacctttacttattcctttattactttcaaaaagattttataatgatttgctaaattctgttcgccctgatcagataatatgtctgcatctaagttaaaaaaatccagaatcaaaatcaaacttgtaaaattcttgttttcaagcttattttttaaatgaacatagagaattgtatgtatttattgtgttcaacatgatggtttgaagtacatatacattgtgatatggttaaatctagctaattaacaaatgcattccctcacatgttatcatttaacatccactctcttagtatttttcatttgaaaaaaattaggttgagcatccctaatccaaaaatacacactctgaaatgctccaaaatctgaaactttttgagcactgaaatgatgtcatacgtggaaaattggacatataagtatttaatgcaaactttttttcaagcacaaaactgctaaaaatactgtataaaattacctcaaagttacgtgtataaagtgcaggaaaacataagtgaatttgtgtttagtcttgggtcccatgcccaagataccttattatgtatatgtaagcattccataaaatcccaaatctgaaacacttcaggtcccaagcattttggataaggaatactcaatccgtatcatcattaactatagtcaccatattgtacaatagatctcttgattttatttctcatatctaactgtaaatatgtattatttaaccgttatcttcataatcctccctctctcttaactacctcaccttctggtaaccaacattttattctctactttaaaatcaaccttttcagattccgcataaagtaagataacgtggtattttttctttctctgcctggcttatttaacttaatatcctccaggttcattcatgttgctgcaaatggcaggtttcattctcttcatggatgaacagtattctattgtgtacgtataccacattttttcttttattcattcaccagttgatggacccttaggttgattccatatctcagcaattgtgaatgtgctgcaataaacttgggtgtgcagatatctcttcaacgtgttgatttcatttcctttcggtatatagccagtagtgggactgctggatcatatgttagttctagttttaatttttttgagaaagcccctactgttttcaataatggttatattaattcacattcccaccaacggtgtgcaagggttcccttttctctaccttctcaggaacacttgttatcttttgccttcttgatgtcattctaacaggtttgagttgatatctcactgtggatttatttacatttacctgatgtttaatgatgctgaacatgttttcgtattcctgttggctatgtgaatgtcttctcttgagaaatgcctgctcagatcttttgctcatttttaattgggttatttgttttcttgctatttatttgtttgagttactgatctattttggctactaaccccttataagatgtatggtgtacaaatatttcatcccattctgtaggttttctcttcactctgttgattctttcctttactgtgcagaactttttgagtttgatgtaatcccatttgtctatatttggttttgtttcctgtgcttttgaggtcatatccagaaaatttttgcccagatcatagtcatggagacttcccttatgtttccttctggtagtcttatagtttcaggtcttacgtttatgcctttaatccattatgagttaatttttgtacatggtctgatataagggtctaattttttctgcatgtggatatctattttttccagcaccatttattgagaagattgttcttttcgcattggatatacctggtaccattgttgaaaatcagctggctataattctgtggatttatttctggcctctgttttattccattggtctatgtgtctgtttttatgccagcaccatctgttttggttaccatagctttgtagtatattttggtgtcaagtagtgtgatgacaccagttttgttctttttgctcaacattattttgggtcttcaagctcttttgtggttccaatttctgtaaaaaatgtcactggtgttttgataaagattgcattgactgtagaaagctttgggtagtgtaggaattttaacaatattaattcttccaatacatgaacacagaatacctttccatttatttgtggcttcttcaattgctttcatcaatgtcttacagtttccaggtctttcacttctttggttaaatttattcctttttttgtgggggcgggtggacagaggacagagtcttgctctgtcgcccagtctggagtgcagtgtcatgatctctgctcactgcaacctctgcctcctggattccagcgattctcatgcctcggccacccaggtagctgggattacaggtgtgtgcctccacattaggctaatttttgtatttttagtagagacagggcttcaccacgttggtcagtctggtttcaaactcctgacctcaggtgatccgccaacctcggcctcccaaagtgatgggattacaggcgtgagccaccgtgcccggccagttcctaagtattttttgtagctattgtaaatgggattttttaaaaatttattttttattttccctaagttattggggtacaggtggtatttgattgcatgactaagttctttagtggtgatttgtgagattttggtgcacccatcacccaagcagtatacacagcaccgtatttgtagtcttttatcccttgcctcccccaactcttctccccaagtccccaaagtccattgtattattcttatgcctttgtgttcttatagcttatctcctacatatcagtgagaacacacgatgtttggttttccattcctgagttacttcacttagaataatagtctccaatctcatccaggtcactgcaaatgctgttaatttcttcctttttgtggccacagttataccacagtttctctttatccactcgttgattgatgggcctttgggttggttccacgattttgcaattgcgctttgtgttgctgtaaacttgtgtgtgcaagtatcttttacatataataacttatttttgtctgggtagatatctggtagtgggattgctgaatcaaatggtagttctacttttagttatttaaggaatctccacactgttttccatagcggttgtatactagtctacatccccaccagcagtgtagaagtgttccctgatcaccacatccatgccaacatctaccgttttttgattttttgattatggccattcttgcaggagtaaggtggtatcacatcgtggttttgatttgcatttccctgatcattagtgatgttgagcattttttcatatgtttgttggccatctgtagatcttctttagggaattgtctattcatatccttagaacactttttgatgggattgtttgtttccttcttactgatttgtttgtgttcattgtagattctggatattagtcctctgtcagatgtatagattgtgaagattttctaccgctctgtgtgttgtctgtttgtttactctgctgactgttccttttgccctgcaaaagctctttagtttcattaggccccagctatttatctttgtttttactgcatttgcttttgggttcttggtcatgaaatccttgcctaagccaatgtctagaagggtttttccaatgttatcttctagaatttttatagtttcaggtctggatttctttttcagatagattgctatgggaatgctactgatatgttgattttgtatcctgcaattttactgaatttgtttattatttctaacagtttttggtggaattttttacaccagtcaaaatggctattattaaaaaacaaataaacaaaaaaatctccacatgttggcaaggatatggagaaaagacaatgcttaaatacggttggtgacaatgtaaattagtacatctatgaaaaatagaatggagatttctctaagaattaaaaatagagctaccatttgatatagtattctcacaactgggtatctacccaaatgaaaagaaataattatattaaaaagatacctcactcatatgtttactgcagcactattcacaatagcaaatatatagaatttacttaagttgattggatgaggaaaatgtggtatatatacacaataaaacattatttagccacaaaaggaataaaatcatgtcttttgcaacaacatggatggaaccggaggccattatcttaagtgaaacaattcagacactgaaagacaaatactgcatgttctcacttacatgtgggagcaaaataatgtgtacatttgaaagtagagtgtggaatgattgacaatggggaatcagaagggtggaggcatgggagggggttgtatgatgagaaattacttaatgtgtacaatgcatattattcaggtgatgaatgccctaaaataaaattacacttgtattccttaaatatatacaaataacatttttaaaaataaaaataggggttctataacattatgtcatcggcacacagggataacttaacttctttttttcctatttggatgccttttgtttattcttcttgcctaattacttccaggactgtgttgaatagaagtggagacagtgagtatcctcgtcttgtgccagatcttagaggaaaagctttcaacttttccccatccagtataattcttgctttattgaagaaaatgccatacttctgtcaaccactggtatagacagctgattatataagttggatcttattaataagtgagaaagtcagcaaaattaaagtgttgctgctttttatataattttaaaggattccgaaaacaatatgattacgataaaatctgaaaaaagtaaatggatatctataccagtttgctcagaactatataaggatggtatcaggttagcttggtcaaatacaagtacataacaaaaaagtaaaataaatatttttaaggctgagttcaactcaagctatttctactctgagtttgcaagtttagttatttgatttcaaatgatccttttgcttggtttgattttccccgaaatggtcaattgtgaataaattgtttgatttgattcgtagttttttaactgagtaggcaaggtctcagatttacttctcttgaagactaataaagaagacattaatatctaacctgtttacaggaacagagtttcttgagcacagctgagcttcccaaatgccatagaaacaaaacgaaatggaagaatttatctggtaggagtgtattttgatgtgacctaatagaattcaatgaagcttcattttataacttgctatacaattaatatatattgacaagccctagtgtcttcaagtcatgcataaaatgcttttgaaacaaattatcagcatttatttgtgagttaaataacttttctaagtgtatcatgagaaatgggttaaacacaactttttggcatattcttcctgctaccacttaaaaaagcacatcatttgtatatttcattttcaaatatgtgacttccttcctgttcatgatttaatccatatttttaaacataaaataagctagcttaacttttattacaacagaagtctgtttatctggagtgaggttttaaatatagacatttttgctccttcagtattgttttaaactaatgcatttcaataagactagtttattatacattgtactgatagttaaagtaactgttaatggctattttttcagggctctgaaaagtaaaaaaaaaaaaagaaaaatcactacccgaaatatcattcttaggaaaaagctgggagttaattggaaagtgaatagaaacactcactctgaatagtcaaaactgatgaaattaataaaactacatatgttgcatttatttatgttctttgttaataatcagtcactaaacctataatttttccattattcacttaccaaaaaataaaaggaaaatttagaaggtgaactagatctattctgtgttgttgtcttgttctgctgaagttatgaatgatttgtgatgaagtccaagtatgggcctcagtctagagaactggctggccaaaacaactatgaattttaacagaattgcatgaagtgctagaatctcagtttaaatgaatgcagtggctacttctaaatagtcagtagactctactttgtatcatagaagtaatacttgtaaatttacaactttgttgatgagttttgcatgattccacatttttaaagaaaaatttgctaaactgaacatatttttgtaatccattaagaacagaatgaaaactgaataacaatatgatctatgttgtacccaaaacctaatgtattttcctgtaaaaaaataaaaatctagcttctgtaactaggaacactacaaaactgaaactgtagactctttaatttcagggttcatgaaggaatttttttccatactgacatgttacattaatactctaggaattaatgttagaagtatttgaactagtattcaatatatgttaatgaaatgtagtacatatccccattggttgtgacctaatcgtttttaaatacgtacattacatttgatagatgctcaattatgaatcctgctttttcaaggtggaatatctgagaaacttgtttcactgatcaaatgtcctgatgtgatattaagatacagtactaaacagcctgaggcagtgagcatttagtctaatctggccagtgcagaacacacctgggcctccctggggttgctgtggtgaccattctgccatctagtcctcagcatcatcagggtcaacaagctaacagtggcaacagagttgtttcatttatacagttccagtgatatcgttgccttcctggctgtgttgtgtttctaatgttgctcctagctctttgccaccatttctaattcttctgctccccaagagtctttgatattatctttagtgtggcccttactgtttaccctagagatagtgaattctgttacttgacaatttaggacactgatgaacagaataaagtataattgtatcaatgtctataagtagccatttaaaaatttatacataagaatcattctctcaggcattaaatgaaattagagaaattatttcatttttggttttttttgcttgtttgtttgttttgttttgtttttttgagatggaatctcgctctgttgcccaggctggagtgtggtggcgcgacctcagctcactgcaacgtccaccttccgggttcaagagactctcctgcctcagcctcctgaatagctgggattacaggcgcacaccaccacccccagctaatttttgtagttttagtagagacggggcttcaccatgcttgtcaggctggtctcgaactcctgacctcatgatctgcccacctcagcttcccaaagtgctggcattacgggcatgagccaccatgcccggccaattatctcggtcttcaaactctgttttagtacttaaacaaagccttaaactgcttcaagaacactgaatgataaatgaattattctacattgaaaatgaacttttatcaattttagttgaatatggtttcttcttccttgagtccagttaaaggtagcttgggagcaatactcaagtcacatcacatgtagttaaacttttatattccgaatcagtcctttaagtaagacagccaggggttgataaactaaccaaaatcctatccgtcacatccattacaagcattacaatgtaacagataacctgaattttcttatatattttgtttcttatattcttaaaatttagtagcaaatacatgttcattcaatttgcctattgaaaatttatcatatttagctttggggaaatatttttaatttttgagattgaaatataaaatactctgttagtacaattcctagaatatatttaacttctgtactccatatgtttagaagaatgagaagtgtattgaaaattgtatcttatagttgttctactataaaaccaattgtaaatatcattcaatggataaattattattatcattgttgttattgttatttaatcccaaattggtctacttaatgtggctaaaatttctcatagactctaattcagaaaatatattttgttttaagttatttgcactaactacttgtgatagatatttaaaaatatatgtgactcatcctgaatagtgattttatgcacagctgtagatgcaaatgaagtatatttattaactaacaaatgctataagcatttttatgttggtaaattaagactgggttgcatgatagttgaatttaattcatagaacacaattatcaactaccctaaaataatttacataactatgacaagttatatcaaaatttactctcaaattaagttggttattcaaaatattcatttttatgtccattctgtataaatacaagtgattgccatactgtaagactcatgctcataatggagaataaataatattttattgtatttatttatttatttacttatttatttttttgagatggagcctcgctctgtggcccaggctggagtgcggtggcgcgatctcagctcactgtaagctccgcctcccgggttcacaccattctcctgcctcagcctccccagtagctgcgactacaggcacccgccaccacgcctgactaattttttgtatttttagtatagacgtggtttcaccgtgttagccaggatggtctcgatctcctgacctcatgatccgcccacctcagcctcccaaagtgctgggattacaggcgtgagccactgcgcctggccgcgagaataaataatattttctaagaaaattaacttttaatttttcacctaaaaatcctaattttccatttttttctatgaggaaattatcattattttatttttgttttaaaaacaagtttcacagataggagtatgttgtgtgctctattttattttttcacccatttttattctcacattttatttttagtaaaactaattgtcatttttttacagaccagaaactctgaaaattagaaagtgacattcatgaatgtagttattaaaaaatactctccatctttcacaggaataaatgttagaagtatgcttatttatggcataattaccagaggaagagaaaattatcctatcaattgaattttatctagaaaatgaaaagtattgttagtaattcctcagtaaatgatacagctatacataataatatataactctaatttagatatgttcttaacgatttgctgaaacaacccagaaatgattgatccagaatcatgagcaaattagataaatcattggcaacaacttaaaaaatcaacaatttgaaaattaaaattatttttggtatatagtatgtgccaagcttagtattaaacataaagccaataaatgcaattcagcatgtgaaaatgtaactttgaattaggaaaattgcagaatgcagagggttgtatttattactctatgtttcttcaatcttgttattgacagaaatttgtatgtatagaaagctgtatgaaaataagtaactttccatacaaagcccaaataaccaccctttattatcgctcaaatttatttatttttatttatttatttttgagatggagttttgctcttgttgcccaggctggagtgcaatggcacaatctcggctcattgcgacctccacctcctgggttcaagccattctcctgcctcagcctccctagtagctgggatgacaggcatctgccaccacacctggctaatttttgtattttcagtagagaccgggtttcaccacgttggccaggctggtctcgaactcctgaccttaggtgatctgcccaccttggcctcccaaagtgctggtattacaggcatgagccaccatgcctggccaattgctctcatttaaattcaaattatgtagcatttatgctccccatatcattattgcatttacttcataagacatacttacataaatttgatttgattgggatattacttacgacattatgttaaagatacattgcactcttggcctgcccatttttaacaacgtaggaaacagctgcaaacactccttactcctgcaaaaatgcaaggaattgaaaataacctatgtccaatcatgttgcacttttgcaaacattccctacctctccccaaatgaagtaacacagttttgaataatttcttcatcatttcttttctttttatatgtttattaaacacacacatattattcctaaagactaaaattttattttcaatatgtttggctttatggagatgatatttaccatgtagtatgttccattcaggtatcaagggatactgtactcagagaatgcaccatctgacatttttattaaatttattggatttaatattgggttttttgaattataatgttggatttatttttttctttggatattatactgctaacattcatcgatattgttttgtgttgttgtggttcttttttcagttctgtataatagcccacatagtagtaaactattcattatatatatatatatatatatatatatcaatgtacacttgtatgtatgtatgtgtgtgtatgtgtgtattagaacagtggtccccaacctttttggcactagggaacagttttgtggaagacaattattccacagacaggggtttgggggaggtgaaaatctgggggtataggggttgtggtttggggttgaaactgttccacctcagctcattaggcattagattcatataaggagcctgcaacttatttccctcacatgcgcagttcacagtagggttggctctcctatgagaatctaatgctgccactgatatgacaggaggcagagctcaggcagtaatgtttgctcaccttctgctcacctcctgctgtgcagctgggttcctaacaggccacagaccagtaccggtccttggcccaggggttggggacccttgtattagaagacacacatatacaaaaccattacaaatcacaaacatatatacatatatacaaacacatatataaatacgtattgtctatttttaattcaaggtaagttttggcaaatagaaagtaatgctttcttaactatcatatttattcaaatatatggaaatttgcctccaaatatcaaatttgttaaacaggtggagaatagaagtaactattcatatcaaaaccatttaaaatataaatataattatcaaaactctactatatattctaaattatatattttttatttgtgcagaggaatgcagttgtaaagaaaataaataaatttatattttgaaatggggcaaaaaagatgtcaaatattgagatataaaaagtagtaccagataaaagatgcatagataaccctaagaatgagaatcacattttatatgtagggctaagccatttcctatatatattttctggctgactaattagcaatggtaaagatcaagttttacatcaatgctttcaaatcatggtgtttattttttctacttgctgagcccgtactttggaattatatattactatattttattgtgtgccctcttgaatgtatttattcatgtagcaaaaataaaaattaattaattaataagataaaggtaattatgtaagattaagaaagtcacagaaacatagaaactgacctaagttagtgcgtactataataaaacctacttatttctttgtctatgtctaaaaatgcatttctttctctatgtctaaaaatgcacaattcaaattccagataaactctagacctgcccatccagtttcctcctctttgtcaacagaactccaattccattcgggtatcaagggagactgtgcacaagcaatgtactcatcccaaagaacaaatcatgattggccaggctaatcatgttgatcctgttctttttctgccagggactgcctggaatggagtgaaattgagatgcctaaaccaatgacagaaaagctacctctgcactccttgctacatgaaataattcaccttttttcccgagctacatttatctggtattcaggtatatagtgttacatgcaatagatatatgaccatcagtgttatatgcagtagatatatgaccaatctagttttttaatataatggtatattggatattttttatactatcaagggattcttctccccagagataccaactgagaaaacctgtggttggcagtgcaggtggcttgtgggccacatcttgagaaaataatgtcttaaaggaattccagtgaaataaataaataaggaaaatatgtttagtttaacttgtgaagaaagcagcaaatgttaatgtgtgaaataagaactttctagttggggatacccttagagctacaatagtttacatttactgaggattcaaacaattccaactgaaatagaaagcaattttatgtcaatacttaaactactcaagcatttagaacatgttactaaaatgttagtatataatctctgaggtagcctataaaaatgtttcagctttctttttacaaatggaaataaatatcttgaagatgaagctagaaacagcgttttctcgtgttcaagaggcatggtattgagaaacaatttacagaatgaaatgagtgaaagaggaagctacagtcagatattttgagatgatttacaggaaagcataaaacaaacaaaaataaaacaaaacaaaaacaaggcagctaccagagagagatactgacagatttttttcttaagtactatctccttttgtcttttagtggggtctatccacctcactcacttcctttagcttaagttgccttccctttaccaaattttgcctcttatcattaacagccacctatctgtcttctctctgctctccacagggctttctttgttccttgaacttgcaaagggacagttaactaatctcattaatggacatgacatttaaaacttgatgttctacattctttgctttaaaacatgtggcattcatgttagccttaggaagaactagtcctccctgagaatgtaggggatttggggttgaatggggggggtgacaggtgactcatcacatcctggagaggatccaatgccacattggtttgcattttgctattcacaagtcactatgataatttcgctacttaaaaaatgatataccatctgaaatttttattaaagcaatatatacatacacacacatttagaagatcatcacacaaataaccatttatttgcttagcttaatgttgcttaggtatttcctcataagggaaaaacccagaatcagtcatttatatttatatttaaaatgtgaaagaaacttcttacatgtttgtatatgacagcaacaatgctaaattttttcttgattcactttagccaataatactttctgttatgatttagttggataattctggattatgagtcagtttgaaatgaggccatgacaaaaataaaatcaaagtaaaactaaaaatatcgaacatcaagagagtatccatctcctaagggtttgaggtgatgagtatcccaattatcctgatttgatcattatacattacataaacacagcaaaatcttatgtgacctcaaaatatgtacaactattatgtatcaataaaaggatccacctcctattgagaaactatacttgaacccattttagtatgtatatgtcaggtacatactgcaaataataattggaactttggtatggaccaagaataatgaatggacatttatctacaggtttatttagacatattagttcttgataacaattgattatgaagacacgaactacttctactaatttaatagaactagagaatcagggaaagacaagctgtatagaatttaaagtggaagaatttattatagagttaaagcttcatccattttattaatgctaaaaatagatacatttatcattatagagtcaaacaaaaaaatttcaatgagtgaattttaatgtactgtagactgtggagatattgaaagtttaactgaagaaaatctgtctagctttacttctcatccattaaatagagcaagtatgcttggcaaaagaatacctaaaaaaatttccagtcccttctctaagtgacaaaattctgatggcctctcgatattttacaacaggtataagcggttatgaagtaaaaatatcaccgtctctgatggtcatctagtctctaatgagggaaaccaataaatccataaatactaatgaaatttttcaaactctaatccccattcttagttatcaatttttgttattttaatagtaatttattcatgtataaaactggaaaatcccatcattaattagcaatagctctttattaatattttaaaatagtttccaaactaaactcttaatatgcctaatgtcatgatccctttaatgagaaactagccattaaaagaaaatagcttatactcatttctatatataagtacatattattttgtaaacagttagcagaaaatttcaccgttaaaaatgaaatattttccatttttgcatttgaatatctgagaatatgttcccgatattcttgccagtttataaacctatattttaacagtactggtaatgcttaattatacacaaatttgctttatttcacatcacaaggctttgtttgtctggagcatacactattgtttacactgtacagttctttttgttacgatttggatgcttttaaaagagattttaaatatttgctctcaggtttattaaaaaacatagacttgaaaaaagatatgatatattcaattataaaaattgtattaacaaattctaaaagtttatcattatcctaaaatttggggtctggggcaaattagagatatgcaaaaatggttagcaaatttttgaatgtgtcttagaaaaaaaattttcacttgcgaccttaggcttttccccctatattttgatatagacttcacaatatagttcttataatagtggggagatacaaaacatttgaaatcaattttaattgacaactttaagatttattatttgatgtgatgattcgaaagaaataaatcagagaaaaaacagcatgctaaaatgtaaatcttatacagactgattgctttggtaaatatataaaataataagagttattaaaacttgtttagaaaaacccaaaatttggacaagattgaggaacaaaggtggttttggataaaggttttgatttcatgagttaaatttttttttcttcttattgcaaaatgtgatggtctattcatatgattttcatatgacaaaagctcctttagtaacctaaaagatatttgaatgattttaagaaatagtttgacataaaatagaacacctcacgtgtgcaattacaccattttattttcttatatattatccttctttatatttgtgcattattttataatgtggagaggttatattacttttgaatatctattatatgtttacacataaacacagagaatgcacagtaagtgatatctatggcactctattgaaagtaaattcttggtgtaacactcttgatcatgaacagatatttaccaactatcaagaaaaacttaagacattgagcaaatgtcattagttaagtcattcaaatcacctcatatttaacaaatctaagtggaagtccaaggggaattccaaataaacatcactgttatactgaatgtagtcaatagagaattattatatcattggagttaaatgaacacatccattacatttctaaataaatgtgggaagtgctttttatcccagacggaataacaatgctaaaggagattgtcatccgtattttataggaaaggtactccagaaatgtttatgttgctaacaatcaaatttactaatattagtcaaacttgaccatataaatcggatttatataatccatatcttaaaattctaacttcttaacaaataccacttgattattttaaaaccatagatgaaaagaacactgagagggaggtttagaagcaggatatatgtatgattttgatgcttcaataactgcaaagccttggacaattcacctctgtgtttccccagatttcatatctgtaaacagactagatgatctctcaaaagaattccacatctaaaactctctttttctgtgtcctgcctttcagtatttttcctttaattgaatcatttattttcttctttgatcttatgcaatgctacaataaaaacaaaaacaaagccaatttgataaaatatcacattctctattagtgatttttgttatctgagctgttacaaaagtggttggatttattccacaaattaggccatccatacctgcctttctgtaatcatatgcatgaagaaagaaaaacttcacaacttgtgtaggagtctaatttttcaatttagtattgacagtctgaccatgggtttgagtgaaagtttagattttgtagatactttggtttcctgataatctcaaaagctcagttatactttataatatttatgtttacaatcaagaaagtctttacatatatttctataataagctataaatattatcaccttctctgaattgtctaattattgtccttctgcatagacaagctagcatgctatacatcatatggataaagccacaaatttcttgccagataattttgaactagtttcaaatattagcaaatatattagggacaatttcatgtcaaaacattgagtagtcatgatataataaagtataatagacaattcctaatgtttaaaaattagtattcaacagtcacagaaagaggaaattatgctttagtttgatggtaacaccatcctagcgtcaagcatggttacatttctcttaatatttttcctagaaaagcgtggcttctagcttatttgattaatacaaatccttcaaaatctttttattctgttctaggatgagaggaaatataacatttatattttaaattaatcataaactatacattaatcttgatttaaaatagaaacctacttttcaaccgagaatgtacacctgtcatctcaaaagaaggtatatttacatattaattttatatttcagatataaacatttattaaattctcattttttgtttcacctgaactaacatgtagttagagaaatacattttagaaaaaattaatagtaagtgtatcttactcaaaataattcactctagattttctcaattattaaatggcaagtgcaatgtttcttctttacagtattatgatattgttactatgcagaccactattcatttttcctgttacttcctataactgagtttcttctttagtattaataaaatgcaacatctatatctcttcagcccctttgtaaacgtgtaacggagtaacacatcttgaacaattctagtcaccattttacgatatgtgcaaaaattcagggactgtaagtataacctacctacaatttttctattttcagaaagccatacttgctcttttggtgtgatcaaggggtttctggagaccgagaagggaaaatgtgtccatttctgagaaacactcactgtaggaaagaaggtgctatttgcatttaatgtaaataccactttcgttccttttaattaaaagagaaacagaaacccttctatattctaaacataaaaaataaaagttttttctcaatatggtagttgattgcaaagaccattctgtatgtagagatggtcctccctccaattttttttagcatcatgctattttcatttagaaaggtcacatgagtcttttgctgaaaccaatgtgattttcctaataagctcaccatgctaagtgatccaacagaattgctctgtttgttaataaggagagtaaatgacattacttgacagaaacgctctttcaatggtggtttattccaagagattaattcatccttacttgtccagtgtcacatatacgttattaaatatgcaatgtagcatccttcttattcaattatgataatttgctgttttattaatacttggaaataaaatatatcactccatccattagtaatcacggtgatgaaactatgtgataccatattagaagcaagtccaaggtattagagatccatgttcaacttctataaaatggtaagttcgataagccattttgcacagttatatttttccaagcttcttgtccttcagatttagttagtggtcaattcactattagaggaatgtaattattttctggttggcactgaggatgagtaagacaaaaatcaccctatcactgaaggtgccatagcctcaaataccctactcactccagctgcatttatatagaggctctcagttgcacaaaagatcaaactgttgtatctaaagatcaagccagaatgcttttcaaacattagatccttcccaaagcaattctttgtgtaaccagtttccaaaaaagtctgaggaaaaatttccattgtttcctatcgttattagactgttgggtcctactgacgtaataaatatacaaatcactattgtttcagcacaatgttttatgcatgacattttaagaactgtacaaaacacaatattaaaattctgaagtgaaaaataatagcattatggctcattacattctatattgtggtagtttgaactgtgagtaactgtactgtcatcctgtcaactcactttaaaagatccgctatattgttttacacaatgtcatttatttcacaggtataactataccaaagtgttccggtttggaaacatagtgtaaatgtttaaaaatattttcacacagttacctgaaaaatacttgcactgaaagctaatcatcagttacagaaccaccaacaaaagttctgctactacaaatagttttgatgaaacaagacaaacaacgtactaaacattttggaataatttttcaatattattattaccttctgatttgttcttagactttaaagattccctaaaatattggtaaatgatgatggaaacctttttctaaaaatattgctttgatggtaaaacgactggcaacaaaatgacagaagatagccctagagatgcctttctccactttatcctagtatgtctttagagccctgatataaatatatatgatattccaagaccctttgctttcatcattttacacagtcactcctacagaagctttcctcataactgtaggatcatctgccgctgatggtttgttcggatcttaattgtcttatgtagtacatactcaattaaaactcatgctggagcaggactgtctagactttggtaactgcttattaaatagttaagatgttgtatgaggagcaagtgacaaattagcaaacatatatgaggctttgaataacagccagagtaataccaggctgaattaattaccatgttaaatatatgcagaatgggaaaataaaatacctgctatgatatggacaaaacttatcttaatatacttgtttgaagatgggcgcttccaaaggaagctcatgagcatatggcgctttactgtgcgtttaaaaaattgtgctaaaaacatgttttgtcctagtaaatgtttttttaaaaatagactttgttttttagaggagttttacgttcacagcaggactaagtggaaggaagagaggtttctcatataccatctagccctacgaacatacagcttcccccaccatcaaaacttcataccacaatggtatgttacaattgatgagcctacattgatacaatgtcagccaaagtccatagattacattaggtttcactcagtgttgtacatgctataggtttgggcaagtattcaacgatgtgtccaccactatagaatcatacaggttgaacatctcaaatctaaaaatctaaaattcaaatgctccaaaattcaaaacttttgaagtgctgataagatgtccaaagcaaatgctcattggagcattttggatttcaaattttcagatttgggatgctcaactggtaagtgtaatgtaaatatttcaaaatcgccccccccccccaaaaaaaaaaaggaaatctgaaacacttctggtcgcaagcatttcggataatatataatcactgccttaaagatcttctgtaatctgtctatacattccacctcctgccgcaacccctggcaaccactgaaaccactcatctgtttactgtgatcatagttttgccatttctagaatgccacatagtcgaaattcaacagtatgtaaccctttcaaattagcttctttcacttagtaatatgcacttacagttcccccatatttgttggtcttttttcatggctttatagctcatttcaaaggtcctgaataatattctattggctgcatgtacctgttcattcattcattcactcacctatggaaggagagcttgattgtttacaagtttggtcaattatgaataattataaatatttgcactcaggtttttgtgtggatatgttttaagcttatctgggtaaataccaaggagtacaattgctagatcatatgataagtgtgtgtttagttttgtgagaaactgccaaattgttttccaaagaggctgtacccttttgcattcccaccagcaatgaaagagattttgttgttacataacctggtcagcatttgatgttgtcagtgttttggattttggccattctaagaggtgcttaacaggtaaatatttttaagtaacaataatgatgctttcttaaaaagattttaaaaaaattcttcaagaatcagcgacacactcctaaaatccaaatactgaacaggagtgcatgttcacattctccagtccagttacttttcagtaacatagacaacagcactgccctactaaaaatcttcaagtgatgtgttctcaaaacatcatcagagaattaaaattagcgaagacaagagaaaaataataacctctgaatcaaatagataccttttaaagggatagtcattactgttacaaaatatagagaagattgtatacttgctattatatttacataaatattattaggaaactcatcaaatgcctcactgagaatttaaaaagtattttgtatcagctttatataaaagcctatcaaaagtgaaatgggattaatttactattacacattcttattcattctgttttcttgctcatcactttatacaattatatatttttaaaaagtacttattgcctttgtattttgtcgatgataggttgtaaggtactgtagtacagaagctgcatctatgcctgtgtgtctcctaaacagtcattgattcaattaatatttgtggacctgttttccagctatcatgctagtttccagaagtatgatcaaaaattacaacaaaagcgatccacacttacacacacaacagcagtcctaattctcaagaacctgtattatagacagtaatatagatacataaaaacaattaaaattcagctttaataagagaaacctctggtgtttggttttatgttaattgtactgtgtcatgatagtatgtgtgtatttttccctaaacataatgatcctagtttgtcttctattagtattttagtagtatatgcctgaatgtgagttttaatttgacattgtaaagtcaataaataacgggagattaaatataaaacatttaaacctcttcagttaagatggcatggaaatttcatgacttgacacttatttaatatatagaagaataagaaagaaaatataaaaaaagaaagagtgttataacacagtaggacttagacacaatcttggcacctccacatatcagacacagtagctgcagtcctgacagactattttccccccatgggtagtggcttcgcatttagattccttcactaagagtccacatgtacaggataaactagaattaagatcactgcttgaagtcacaagttatggcaaaagttcacccagcaatcattcttgaaaagaaaaatgtcttaaaaattttgctgacctgctgcctgagagcctattatgttaggaatctgttacactagagatacgggaagaacacacacacacacacacacacacacacacacacacacacgccatgaaggcagaagcagcccaaaacaaatgaatttgagtactgaatcttcaatatttctaattaattatcaccacaaacagcactccacgtggtagtagactatctgaatctaggcagctattccaggggccagatggggacaacagcaaagtggtggaacagatataataaacacaatgacaataaaagcaaacccttttactctaaatgctccagaaatctgtgaataaataaaggcctaaaaaaggcagaaaaccaccaccaccaccaccaccaccaccaccacaaccacaatgattcaaccatgagttcagtctagatgaaattattctcatatagatgtctgaagaacatttttaaataatatgtttagaattctcaacaataaaattaaaagataaaactcaataaaaagaacaagtagttataaaacaaaagcatgtagaaattaaaataatttcatattgagaagaaaaaagctataaatgttggaaatgaaaaatgtagtaaatgaatcaattttaaagaaataaacagcttaagtatctggattgaacaagaagataaaattagtgaattagaagatactaatgaagaattcatccagaacgtaacacagggaggcaagtaaatgttaaaaataaaatactaaggacataaaagatggacaatattatacgacaataagagttcctaaagaagagaatgaatggaattgcagagaagccagatttaaagataatggctgataattttatagaactgatgatagacaaagggcaaggtttatctaagaaagttttgaagaaaaacaagttagggtgtctggccctaccacatgtcagggctaaatataaatctatggtaattgagacatattatagtactggcacaggaattggcaaatgaagaacagaacaaaaaaagatgcccagaaatactaatgtacatactaatctaatgtacatgtatatactaatctcgatgcaaaacagaggtgacactacaggtgaatagagaaaaggtagacatttaaacaatgatggtaggacagttatttactctaaaataattcacaaaattattcactattcacaaaaaaacccctaaaaattatttccaagtttatttagagaccgatgagtgaaagggaaaaactgtaatacctaaagaattacatgaaaataagaaatagaccaaaagtcaattgaaaaattggcaaaggacatgaacagatgattcagagcaggaaataataaagggtcaatgaatataaaagatacattgatcaaaaaacaaatgagatataatttcatactcatcaaattgataaaaattataaagtgtcaatatctagttgataagaatttgaaaaatgggggatgcatacactactgttggaggcataaattggtaccaccattctaaaatcaagtacggcaaaatgttatattaatattatttttagtcatcctccagttgtttgacatatttcataataataaaatatatacatgtatcaaaatagctcaatttaaattagaaaatgaatatacatgacctatctttaagaactagtctgtatgtttaccatttccatttgaacattttttattcatttctcttatagatcctatatatttaatgtgttcttgcttttgctgttaaaggcaagactggagacttctttaaattacagtgctttatcaacatgcatcattttagattcacaagcatccttaaccagagtcagagagctttttaaaaaatatatatatatatatatagaaaactgctcccttttactttctgtgttatatggattttgagtttcttagttttgagctatggaattttctttctatgggtttattctttttaaaagtagtgctatttagatttccatttatatattgttctttagccccttaagcaaatcatcagacttaagggcaccattcataatactattattacatattattagtcaaatatctataaaaagatgaatatgacaccaagtgatagaatgtcatcagtctctctaaaaataatagtaataaaaatagtaatacaatcatacaagaagttgtttgctcaggttaaatttaatttataccctgaaataataagaattatattgctttgcacgtctgggaaacagaacttacaaaaaagggaaactgactcataaagtacttatattttaaaattatttatctaattctcatttgttcaacaaattgcacaaatatacaagttgaaaacagtataaaaataatcttacacttaagatcttctttcaaatctagtctaaacaagtctactggaagactttggatagtcttctatgttagtactttgcctctgctggatgaaagaacacaggcaatcaacacagttaatgaagaaaaatgtacatattatagtcattgtttggcctgtatatacatattggaacttactctgctaggataaattgcacaaatatacacgccttttctaaaataaatgcactgtcgagtccatggataaagtcctatccttgccagataataattctaaaaacaagaaaccaaaaataaaaaaataaaattttgaaaggaaataaaacttcatgtacctttcaagggagtaggtgacgaagatggtgctagaatgactctcagcctagggtggtgtgtcataagattagaaagatgtgttctaatctctgtaagccaagtggtagttcatcagcaaaaattatcagttcattgttaattcctggtttatttctctttcagtttttaccgcctaaagtcttgtttaaaacttttgactgggccagatttaagattacacatgttgttaaggggcaaggcaggtcctagtttaccctaggattagaatgttaagccaccaaccagcaaaataaccctagggacaaaataaagtcagttggatcagaattgaaactgaggggtctccactcttctttccccaaagaattttctccttcgttatgaatctggaggatatgtattttagtaaagataaaggttttttttttacatatattgattggagggcattcataatcaattttcaaagaaattagcattgaaggaaataaggagcaggttacaatttctttacagtcatagtaggttgtgggagagatgctggactataaactcccatattctgagcttgttatcctggcacagaaattatgatgacattgaaaaaaatattttcataatgtagtccattaaatttcatgtctacattatggaaactcagaggtttatggtcacataagagtgaaagggcaatcaaggagtaaggaaaaattatgcagaaaggagaaaagcaatgatgcttggtgagaacaatcatactaagtgtgagaacaaagatgatgtacctagttcagattttctagtcacttgaaatattactgacctctaaaacttagggggactttaggctgagtccaggaatttttttttccctaaagaactgtagacttggcaagtctatatttagtgtactcactgtttttctgaattttgcctagatcctgactgtcacaggtacagatgaattcaacacacccggagggctcttgttggaaacctgaagaatttccatgaaatctccaaaagtcaaaagatgccattattacaacactctagaggttggcaaactaccttttatttatttatttttttgctacaattgaaaataaaaccaacatgtattgttccataggccccttgtaaatttatttgtataaactgctgagaatttacgttaatgtcttttacttcttctttttgcatttcaattgaaatcctaggaaactttggcaataaaagatccaataagttattgataatttaaaaaatgattccatagcatcaacaaactatattaaattccaatatcccattctatgattcagtcttggcccatgtaaatctgtgatagaaaataagctgaaaataccaatatgggcagaacaaaatacgtaaagataaatctctcaatttttatatcatacgttccaggatatttaatgaaaaacactttgagtcctaagagtccatattaatagaattccacgttaaaactcctgaacttaatataagctttatcagcaacatagctttcagttaacataaaataaatgtaaataacattgacaggtcattttagtactaaatattagtgctttataagcaactaaattatttagtcagctttattccagataagaagacccttggatttattaaattatagattaaatactgatgtgtctgactattcctgagaaacaccgaagccccactatgtctagaatattgatatttactgaggttcatacataagtcgctatgctagtgagagattcaagatgaaactctagctttctctttattaaatcagccttggcctccccttatttttatgtaggtattgatttccttgatttgaagcaaactttcctcttttgagaaaaataaatcacaactcattgctttaccatctctcccacttcttctaccctaaagatagctgacaaggctggcaataaaaaggtagaaaaagtaaagagtcttacaacgtagatgatttttgacccaggaagtacaagtttaatataattaaaagtgcaatgttgaaatcagcaagagtttgtatttttgaattattcaaccccattatgttctctatagaaaaccaaagaaaaataaataaccaaaagagaagctgcaaaagtgtttcattgagtacagcgttcaatacctcgtcaaataggagttaaagatttagtgaaagttgaaagggtggttaacttgaaagaagatagttggaggcaatacaaatatgaattatgatgtttgcaggttttagaagaaagtcttggattttttcatcaaatgacagatgagagacgaagcattttttatttctgtaataaaaagtatgggtggctatactgtcacttaaatatttttaattgcgaagaaacatctcatcaagtaaaaagtagataagaataaacaagacgctaagcatagacagaaagtgtcctattttaatgcagaaaaaagttttcaataaaatccaacatcccttcatgataaaaaccctcaacagactaggcactgaaggaacatacctcaaaataataagaaccatctatgacaaatccatagccaacatcataccgaatgggcaaaagttggaacgattcccactgagaactggaacaaaacaaggatgcccactctcaccagttttattaaacatagtactggaagtcctagccacagcaattaggcaagagaaagaaataaaatgcatccaaatagaaaaagaagtcaaactatcttttttcactgacggtatgattctatacttagaaaacccaaagactccaccaaaaggctactagaactgataaacaattttaacgaggtttcaagatatacaatacataaaaatatatttttatagtaaaacatataaaaattaatagcatttctatacaacaataatgaccaagctgagagtcaaatgaagaacacaatcccatttacaatagccaaagaaaatgaaatacctaggaatacacctaaccaagatgctgaaagatctctgtaaggagtattaaaaaacattgttgaaagaaacacagataaacgaaaaagcattccatgctcattggaagaaacaatataattaaaatggctatactgcacaaaacaacttatagattcaatgctgtccttatcaaactaccaaggtcattcctcacagaattagaaaaaacaattctaaaattcatatgcaaccaaaaaaaaaaataaaagagcgcatatagccgaagccatcctaagcagcaagaacaaaattggaggcatcacactacagtacttcaccctacaataattcacaccacagtacatcacactatagaacttccaactatgctacaagactacagtagccaatacagcataatattggtacagaaacagacatatagaccaatggaacagaatagaaaacacagaaataaagccatacaccttcaaccagccttcgacaaggctggcaaaaacaagcaatggtaaaaggacttcctattcaataaatgatgccaggatcactggctagccatatgcagaagaatgaaacttgatccctaccttttgccatatacaaaaataaactcatggtggattaaagatattaatgtaagacctaaaactacaaatcctagaaacaaacctaggaaatgtccttcttgacattggcattggcaattttttttttttttttgacagagtctcactctgtcgcccaggctggagtacagtggtgtgatctggactcattgcaacctctgcctcctggggtcaaacagttctcctgcctcagcctcccaagtagctgggattacaggcgtctgccaccacacccggctaatttttgtatttttggtagagacagggttttgccacgttggtcaggctgctttcgaactcctggcttcgggtaatccacccaccttggtctcccaaagtgctgggattacaggcatgaggcactgcgcccggccggcaaagaatttttggctaagtccccaaaagtaattgtaacaaaaataaaaattgacaagagggacctaattaaactaaagagcttctgcacagccaaagaaactatcaacaaagtaaacagataatctacagaatgggagaaaatattcacaaactgtgcacctgacaaaagtctaatattaaaaaatggacaaaagacatgaacaaacacttctcaaaggaagacatgcaagcgaccaacaaacatacgaagaaatgctcatcatcattaatcatcagagaaatgaaaagcaaaaccacaatgagataccatctcacaccaaacagaatggctattatttaaaagtcaagaaaggctgagtgcagtggcttgcgcctgtaatcccagcactgtaggaggcttaggcaggaggatcatatgaggccaggagttcaagaccagactggccaaaatggtgaaaccccgactctagtaaaaatacaaaaattagctgggtgtggtggtacacatctgtaatcccagctgctagggaggctgcagcatgagaatcatttgaacccaggaggttgaggtgcagtgagccaggattgccccattgcactccagcctgggtgacaaaaaaaaaaaaaaaaaaaaaatcaaaagataaacgctggtgaggctgtagataaaagggagtgcttatacactgttggttggaatgtaaattatttcagcccccgtggcaagcagtttggagatttctcacagaacttaaaacagatctatcattcaattcagcaatcccattactgagtatatacccaaaggaaaatagatcattttatcaaaaagacacatgcactggtatgttctttgtcacacaattcacaatagcaaaaatatcgaatcaacctaaaagctcatcaatggttgactggataaagaaaatgtagtacatacacaccacggaatcctatgcagccataaaaaagaacaaaatcatgtcctttgcagcgacatggatggagctggaggacattatattaagcgaagtaatgcaagaacagaaaaccaaatgccacatgctctcacttataaatgggaactaaacattgagcacaacggacataaacatgagaacaacagacactgtggactactagagtggggagggaccggcggggaaggagttaaaagctacctattgggtactatgcttactatctgggtgcaatataccgttttaacaaatctgcatgtgtactccctgtatgtaaaataaaagttgaaattaaaaataaaagtgtcctactttaaagaaaacatgccaggcacctattacacagcaagtatcattattcgctcactacaattattttcagattgaggcaagttcatagttaaaaatttaattggggtgatataatacaatgtggtttgtttagtagtagattttattttaatagtgttatatatgacttaagtttatacaatcatcaagagtctgatggggtctctgtaattagccatactttactgcattttatgagtagaattatatgccttagtgatgtttgcaaattcggagttttgcaaagatcttgggacaaataccctggggctcttcagagtctaatatatacgtaaaataaaaggtcataataaataaaatcatatggagcttatatatatgtatatatatataatcacagatttataatgattaccaagtggatcgtagctataagtgatttaacaggggcaatgctttctttactctaccctgatcaacacaatatttgggtttatgtctctagtgagataacgcttatgtttttatcttgatacttttaaaattcccacttcaccttctggtccttatttttttcatatatcatcaatgggtattcaaggaaaagaaaattattgtataagggttgaaaacatcaagaaacaataaatagtcagatttttaaaacattttcccaaactatcttttgagagccaaaattgtagctgtgagtaaagtaaggctgagtttatcctaaagcaatagacaaggaaaaaaaaaaatcagacaaagaatggcaactctatacctctctaccctgagacacacctgagaccaccctaaaaatcaccagggctgagaataggaggcacccactcataaaatgtatctacccactctcatttgcatggctctacgtgggtccttctgcttttgcaataccttgggacatttacaatcaaccccctcacaacagagagttaagtgccttgatttccagacagtggtgagttttagtagggaacgcctcagcttagacacttgagaagaaactagacggcagcaaaatccatcccgttgcacacgtcctcaactaggaaatgttaacaccttccaagattatctaattttatggtcaataattggtcttcagaaaaagagagcaaatataagcaaaatataagggaatagtatataaacaaaaacaatttcaacacaggaagctgaataaactattaatttttagagaaagggtcaacataagatcactgcttttttatgctataaactatatatatggcccccaaacataaatgaatataatcttggctgtatttatttttattgctttaaaaatgaattatttatattatcaacagctgtggctaaagaaaaaagacttttgtcatccaaacaaagaactatttataaccctgatattccaaggtgtatttaaaaaggtgttatttgtggcaatattgtatctattttctcgaagatcttaaaattagcaattactatcaatgaacatttattgaatataaagtaactgtatagcatttgtatctaatgcatttctaattgctaagttacagttccaacattttcatagtgtccaagtgattattttatatatttctttttaaataataaaagtatcataaactttttggaaaaactaaacttcctattttattgctacttattgcctattatttaatcttttatatgttaacatgatcaaaggtgtaaaaaattaatgatccttaattttacctaaaactaaaaaaaaaaaagcaaatatttatcaaatgctgaatattttttaagcactgttagcaattatctatctgtctatcctagaatctccactctgaacactgcattccatgtgatgaaacattagatatgaaaacacaaggctgggcgcggtggctcatgcctgtaattccagcactttgggaggccaaggcaggcagatcacctgaggtcaggagtttcagaccagcctggccaacatggtgaaacctcgtctctactaaaaatataaaaattagccgggtgtgtggcgggtgcctgtaatcccagctacttgggaggctgaggcaggagaattgcttgaaccccagaggcggaggttgtggtgagccgagatagtgccaccacactccagcctgggcgacaaagcgagactctgtctcaaaaaaaaaaccaaaaaaaaaaaaaccaaaaaaaagaaaacacaataagaccattcaatgatttaagttaaaacatgaatagtgaccatgtgagtggcaaagcaaatgtgtgttctttttcatttttattttttttgagacagagtctcactctgttgcccaggctggagtgcagtaatgcaatctcagctcactgcaacctctgcctcctgggttcaagcgattctcctgcctcagcctccctagtagctgggattacaggtgcccaccaccacgcctgactaatttttgtatttttagtagagacagggtttcaccatgttggccaggctggtctcaaactcctgacctcaggtgatccgcctgcctcagtctcccaaagtgctgggattacaggcgtgagcctccatacccagcctccctgatccctttaagatcttttcccccatttttccaatgacatcttatatgcatatacatgagatagaatttgtgttctaaattcaaagaaggaagagttcattggatttggggagaacttggacgatgttgagttggttggtattgatcagagaggaaatgtatttatagagaaatccatgtagagtgaagtaattatcaaggttattttgtgactgatatgaattcaaggggcagtttataattcagtcacatgttaaagaacaaaaaggacgaaagaagaataaagcagatagaatcgtgaaatgggttacattatttgcaccataaagtttaagtaaatcaaattattgggaatattctgagatagagctaaagtctttctcaagagtcatggttgaaaccacatgttgtggaggaactgatggtgattgttgccccattgtgggattcctccctatggtaatgacatcaaaatgaaaaaaaaaaaaaacacacacacacaagaaaatgacgcagattgtaattagaggtggagctgtttatgatctggttatctccacattgttctgggaaagaattgagacattactgggtcaaatcatgtctgtgagacaaaatgaaaggtaaaaatagtgaataaaaagagaaagattagaaacaagctttagtcacttgctcttccttgcggtaggcccttggaatattgacaaatcctaaaataatttaaaaaaaaacagtggattttaatcaccatgagggtaaaaatagtcttgtttaccactgtatttccaacacatagcgtggtatctgaccctccctaaataattattgaattattgattgcacattttagactactatattagcatatcccacctctaagcattaccctgagatgtaactgtgcaatacagcaataaagggtgtcactgtgtcctcagtccaggcctaacacacagttgagctctgaacaacaatgtaacatcaaacagtgaccctgttgtaacatgttctggacttgtctaagctaaagttcaaatatgatacttccaaccctggttataatctctgaatgatgcattttatacatagcaatgacttttttattttttaaaaaagaagcatttaccatgcaagaaaaaggacaacattgcttcaagaatagtaatcagtcagtggcacccatcttaatgagaggatttacatcccattgttttcattttaaatgtcaatgtgcatacatataaacatttagaaaaacaggtttccagtagatcatgttatgtaaaggtcatacagaccttgcaaatattcctgcatctctaactaatctaatccggttcttgacttcaaatatcaaatgatatcccttactgccacccagaattttgaatgtctggtattgagtggtttctaaaagtttgactttttatatttgaagggcccacatgaagccatacgcaattagcatatgctgtattgtggcaagttctgttaacatcagctctttgattgaggaagaacactaactgttgaatcatcaaaacactacagcagtattttacaacctcagttatgcataatgtgaagtaatatgcatggcctgccctctgtaaatatgagaggcaatttgtttggctccacattttattttgctttcaggattatactacttactaacttcaacaaaagcaatataataagaaatattgcctcacaataccacagctctgtccatcaatagcaaaaattctcaatcttagcaccagtgccaggagatgaatctcattatgataattcagtgattgtatacggattcacatttcccagcatacataagagaatacaaaacaaacacaagtaggataagcaatcagataactgaagttttttttgtcaaagatattaaagagtatgttaagaatcatctaatgtcatctccctattactggaaaaaatggaagctcaggatttatataattagctctaggtcacacaggtagtttgatggtaaatcctagagaattctactgttcatatttcttaaacacatattttcttcattatactttatgtattacagtgatattagccactaccaagtcagcactaattataacttgatagatttaaaggtctaagctgaaaatatttagaaaattcatgttgagaatattgagaaataaggtgggatccaaggtggcatgaaaggtcagagtcttagtctgaactagaatgcatgcatgtaaggcacatgctagaaatttgtgagcaaaggaagaagtgagaaaaaaatgaatatttagtaaggttaatttgtaattagtctataggataaggtggagtgtagaaaccattctgccagggagatgaaaattagggaattgcatgtacaaattcattagctaaaataaggttctgttgtttgagtctctcaaaagaaatcacttctcaatagttatgtaaatactgaaatacaactttgaaaataatttttagtactagccatcaaaatttggggcttatgatgtacaaactgtgtgtttcaaacactactgatgggatctgccatcgaggagcccatgactgagattcctggtatgtgctatatctgtatatctgcctcctccaggaagatttgagggcctcagaaactttttccaaacgtttataacaaggatcctaagactattgccttcatagcgaggaagccagcaatgagctggatcctggacagcatgctggcccctgacatgggcaacaaattagatgggccacagaacctaatttctatagccttgactcaccacaggtttatgctctcccgcacaatggcattggggcaagtttatgtctttgtcgtgttgtgctgtttgttttctaagcaaagggcagtctcctatctcatgccaaatttaaaattcaggctgcatgaaatcttagagatttcacttaagcttttgtgcaaattagttggtttgattgaatcagtgtatggtacagcctagtaaatgtcattcttatattcattcaaaagaatacatgcttctacaaatttgctcataaaattagcaatgaatactggtggagagtcacacatgggaaagagaaaacctggctataaatctcagctctaccactgactagctgagttaacacgaactttaagcccttttaactttggcttttctcatctgaaaaatgggcagaaaatgtgggattttgtgaggaatagaattaatactaagcaaaagttcagatccgttttaaatgtcagcaattatttttctatttaaaaaagtatatagcgtatgttcatgtatcactaaaaatcatttctgggacaagctgagacataccataattatgtgtcaacacctgaggtacgtgtaattaatgctagagaaggtcagaagaagggagcttaacattggcaatttgctatttaggaagtgttccaaagaaaaagtgggattgtgatggactatggaactcagattagtaagacttggactaaatgaaagacatcctaatgattcaacaggactaaaattaaatatggaattgagcaaaagagactgagtgttaacatcctagaaaattgggaaaatattggcataatcatttgcccatgggaaagcatatgacatgtacttgcatacacatatattccatatatgcatgcatctctgtgtatgtttacgtacatatacatatcatttgcactcagaaaacactattactaacactacaatcatatatatgtggtgtgactatacaattgtatgattgttttctttgaagttcattaaaatcacatatattacttgcaaatttccgatttatgtacatatgcatacctcttaaaatgggatatatagtattccatctaataaagatgaaatttttgtcaggcttggaattcaagagatcttccttttatgtattatatttttactcaaatggaccactgctagttaagtttctttcaagttttctctgattcggtaaatgccatttgaggagttcattaacatgcgtttaaattcaggttccagtgcatgatgacggtcacatcaggccatggtgaaacaggaaacacatgaagaggctggagtatttttttttaattatttcattttttaattctgtgatcaggtccttccaagttttggtgctgatagggtctttttcttttatattacaatggtgagaagccctaattagcaaagtaagaaaatggcaactcaaggttgatctctggtttgtttctaacttgttttaaatttagttgaatcatgaagtctaaaagtccagagagcacgaaactaagctacattaatttgaacatctgacataagttagactagtatttttcaagttgtattctatagagctccccaattaaattcagcaaaatgatactggtattgtaagtaaaaaagaaagtaacaacctattacatttctttctttgtcaaaaatatgtaatctacgaatcattggggtgagcatcaatattatatacatgggatgaaaatgaatttaatttcattaggatcaggctttaaagatctaaactaaggctgtttgaatttttctttttaatttgataaactacaagttcacaggaagtttcaaaaaattgtatagggaggttgaaggtcctgtgcacccttcacggaggctcactcaatatttacatcttgcaaaactgcggtataatatcaaaagaattgacattggtataatccataaaccttcttctgatttcaccatttatgtacgtatacatttgtgtgtgtatgtgtgtgtgtatatatagttatactcaattttaccacatagatcacttcacgtaagcacaacacaagtggtagatgtaccatcacctcaagacaccccatgttatccttttataggccacctgccaccttcccccaatccatatcacattatgctgagtgaaataaaccagtcacaaggggctgcatacagcatgattccattgacatgaagaccaggtcacccaaatccttagagacagaaagtggtttcgtggttgccaacagctgggtgagggaggagtgtggactaactgataaatggatacagtggtgcctttggggtgatgaaaatattttggaccaaaatagagatgatggttgcacaccatcgtgaatgtacgaaatgctattgaattgtacactttaaaatggttacttttatgttatgtgaattttacctcaatttaaaaaatgcaacctcatggccctctgactgtccatgagagaggccagacttgcagggcagggtctgcagtttcctgagaacccacaagcagacacgtccttatgagatgcatgccctggaaatttctttcacaacgtgtttatgactcctggacattttgggctgaacagtcacaagagaagctagtcatgctcaatcatattttgcttccatggcattttcccaccctcagcctcctactccttttcatagacacacacacaaacacattctgctatatctatggatccagcctctgagccctcaaggtggaggagttcacaagcgggcaaccactcatctatttgccataataatgttacttcagaaatgttacacaaatagagaccagatgcagtggctcacacctgtaatctcagcatttcgagaagtcaaggcgggaggatcgctggagaccagggatcctggtctgtcaccatagtgagaccctgtctacacaaaacaatttttaaaaatgggccaggtgtggtggtgtgtgcctgtagtcccagctattcagaaagctgaggcaggagtattacttgagcccaggacttcaaggctgcagtgagctacaatcgcaccactgcactctagcctgggcaagagtgagaacctgtctcaaaaacaaacaagcaagcaaaaacaaatggaaacatgcaatatacattcattttagattgttgcttttccttttttacatttcaacttttattttacatccagggggtatatatgcaggtttgttacaagagtatattgtgtgatatttaagtctggggtacaactgaagtcatcacccaggtagtgagcatagtacccaataggtagcttttcagcctttgccccttcctccctcccctcgattgtagtccccagagtctactgttctcatctttatgttcatgtgtactcagtgtttagctcccacttataagtgagaacgtgtggtgcttggttttctgtttctgtgttaattcgcttaggataatgtcctccagctccatcaatgttgttgcaaaggatatgatttttttctttttttattgctgcataggatttcatgatgtgtatgtaccatattttcttcagccaatcaaccattgtgggcatgtaggttgatgccacatctttgctattgtgaacagtgctgtaatgaacatcccagtgcatatgatttttggtagaataatctattttcctttgggtataaacccagtaatgagattgctgggtcaaatggtagtccttacttttagttcttcgagaaatctccaaactgcttttcacagtagccgacctaatttacactcccacaaacagtaaagtaaaaaaggacaaagaaggtcactacataatgataaagggtgtaattcaacaagaaaatttaactatcataaatatatatgcacccagcattggcacaccaatgtcctaaatcaagtacttttcaagacctacgaaaacacttaggaagccacacagtaataatgggggacttcaacaacctactgatagtgttagaccgatcactgaggcagaaaactaacaaagaaattctggattaaatttgactcttgaccaactagacctaatagacatctacatactactttacccaaaaccacagaatatacattcttctcatctgcacacagaatgtactgcaagataaaccacatgctcagccataaagcgaatctcaataaatttcgaaaattgaaataaaagcaaacaaattcttggaccacagtggaataaaaatagaaatcaataccaagaggacctctcaaaaccacacaattacatggaaaccaaacaacttgctcctgaatgacttttgggtgaacaacaaaattaagcagagattgttattttttttcactcagtataaattacaccaggtttatccaatagttaattcctttttattgctgggtaatattccatggtatgcatgtaccacagggtttttttttttttaagcaattacatatcaagggacttttttgtgtgttttggtactataaggctgctatgaatatttgtggatacgtttctgtatgaaaacaagttttcatttttttaagaatgattaagagggcaattgctgtgtcatatgctaagtccatttttagtttgaaaatgaactgccaaactattttccagtgtggctataccatttaacagtcccaccagcaatatatgatttacccagtttctccgcttccttgccagcatctggtgtctattttcttattttagccattttgactactaggtaataatatctcactttggttttaatttccattttactaatggttgttgatgttgaacattttttaatgcatttatatatgccatctgtatatcttcattggtgaaacatctgtgcctgtcttttgtccattttcttattggatttttaaaatgttgagttttgagagctctttatgtagttttgatactagttcttgatatctagatatatggtttgccaatattttctcccagtctgtagctcgtatttcatttttttctttttttgagagtgcagtggtatgatctcgactcactgcaacctctgcctcctgggctcaagcgattctcatgcctcagcttcccaagtaggtggtactacaggtgtgcgccactacgcccagctaatttttgtatttttactagagacagagtttcatcatgttggccaggctggtctcgaactcctgagcgtaagcgaccagcttgcctcagcttcccaaagtgatggtattaacaggcacgagccaccacgcccggttatatttcttcttaacagaatattttgcatagcaaaagttttttattttaatgaggttcactttatcaaaatttccttttatggatggcgactttggtgtcaagtctaagaacactttaacgttagatcccaaatatgttctatttttgagtaagttttacagtttaagttcttctgatgtttagatcaaggtgttttttgtttgttttttgcctatgggtgttggattactacaacaccatttattaaaaaggctaaccctccttactggattcctgcttcgtccaaaacaaagggacacaaggaaacttttccagggaattgatgtttgttatttgattgtggtgatggtttcacaggtatatgaatatgtccaaactcatcaaattgtatacattaaatatgtgcagatttttgtatatcaattatactttaagctgtaaaaataaataaattgggcatatttgtggatctatttctgggctctctattctgtttcactgatatatgagtctgtacaccaccagtatcagactgtctagaatactgctgctatataattaactttaacaacagtaagagtgatttctctaattaatttttccttattcaatagttttggctagtataggtcctgtgccattctatacatcctatataatttttataataagcctgtgtaagttcaaaaacattgctaaaattttcgtaagaattgtcttaaaaatagatcaacttagagagaattcacatctttactatggtgagttttccaatccatgaacataatgtatctccatatatttaggtcttctttatttattttactagcacttggtaacttttatcatacagattctgtgcatgttttgttagttttatatgtaagagtttcattttctttgcagaaatcataaatgctattgcattttttttttttttttgagacggagtctcactctgtggtccaggctggagtgcagtggcgcgatctcggttcactgcaacctctctctcccgggttcaagagaccctcatgcctcagcctcctgagtagctgggattacaggcacacaccatcatgcccagctaatttttatatttttagtcgagacagggtttcactatgttggccaggctggtcttgaactcctgacctcaggtgatccggtcgccggggtctcccaaagtgctgggattacgggcatgagccactgcgcctggcctgacttctactttaaaattcttgtcagataatttcaacatctaatttatctaagtgatagcattagtcgatgtcttttctcattctagttttgtttgtttgttttggttctcagtatgcaggcgacttttgatggtactctggacattttgtccattatatatgcagaatctggatcttatttcaatcttttattttagcaggtatttaccatacgtagttcaatacacaggtgccattctacttttatgggctgtggtcccaaagacagttttattttcagagtatttctcgtgttattgaggcctgcttggtttatctagtgatgctggtactctcaaaaatccttgatggtacattctgagtgggcagaaggagttccccagactagggtgctggtgctgctaggtagagtaggggtttcttagatctatagagataaaagtgtttcctagataggattattgtgttagaatccctatactggtaccctccagctgctccaatgtctctgggtaaaagtggagggattctcatggccatagcgtccaacgggcttcccaggctagtcactctttgtggtggatagccttaccagtgctctgtgtttgcccaggtatctctgggtggggaagagaagtcctaggtccatatgaccaaagatgctttctgaaccaggtcacttattatgattgtgtctcttgtaatttctgcctttccacctcgatgtcttcctgtcggaaaagagagcctcagttctgcaggtatgaagaggcttcagtagttaggacacttgtggcaagatctctgtgcctattgggaacagacagtgctttctggatgggattttgttcttgagggatccctcttctagtaccctgtggctgccccagtatctctgtacaatagagggcagcctcagacccacaggaacaaagaggcttcctgcactaggccacttagagtggtaaaatcccttgtggcagttgcacccagccacctaagtatttcctgttgtgagtgagagtgagtgagagtgtcttaggcctgtagggacaaagaggcttccgaggttgggccacttgctgtgacaaaattcctctaaacaatactgccacttgtctatttttcagcagagcatggtagtcctaaatccctgggaaaggagaggcacttaccctagctgcttaatgttagatgggctcccattcaatagcccttgccagttataccaggctcatctggtattgtctgagagactcctattcaattcagagaggaaactagctgggctgccttctgctactaggcttgaaagttggaaaatgacaggtgggggtccccatcttctgttggataggggcacatatgagaatgtgctgcagtttattttcctctagcgcgaggctctcaaagcagtttgcttttctctgactatcctttacaattttcttttgatggcctcttgttttgtttctaggttttattgttcttcttcactatgaggagcagggaaaaatcagtttatgccatcttgtccgaaatggaattctcagtcttgttttaatatgttttaacacgtgattcagataacttggtttttaaaatgtgcacaacttttaaaaagaaatgttccaaaagctaaatatacatttaattgtaccatgctgcgtgtagagtagctggtaactactgaaatcataagtacatgtcagcctttgaaattaataacaaataaaacatcaacttggtcaaatgcggtggctcacgcctgtaatcccagcactttgggaggccaacgtgggtggatcacctgaggtcaggagtttgagaccagcctgaccaacatggtgaaaccccgtctctactaaaaatacaaaaaattagccgagcgtggtggtgggcactcgggaggctgaggcaggagaattgcttgaacccaggaggtggaggttgcagtgagctgagatcgcaccattgtactccagcctgggtgacaaagagcaaaatttggtctcaaagaaaaaaaaaaaaaaacatcaactataccaagtgatgagtagaatgactgtactaggtatgttcgttttcattgtatatttagtatttatttaagcaacctaactaaaaatagtgccgacaataaaaatatctcaatttacagaaatatataaaactttaatatgtagattgtattttattatttaattttatgaaaacatctgtcgaggccaggtgcggtggctcacacctgtaatcccagtactttgggaggccgaggcgggtggatcacaaggtcaggagattgagaccatcctggctaacatggtgaaacctcatctctactaaaaatacaaaaaattagctgggcatggtggcgggcgcctgtagtcccagctactcaggaggctgaggcaggagaatggcgtgaacccgggaggcggaggttgcagtgagccaagatcgcgccactgcactccagcctgggcgacagagaaagactgtctcaaaaaacaagacaaaacaaaacaaatctgtcaaaattatgcaaacaaaaatgtctaccaacttgaaattacagatgagtacatgactataattttatatatatatataaaatacacatataacatatgataaagtattcattaatcatttatgtctctagtttgaacaacacagggagttcaacatgcacctagcacactgcgtaagcctttctatagatgttttagccaagatcaagactgtctattaataagacatctaaaacatttaatcaagcacatttggtttgaatataaaaagatgatagagcaatcaggtttttctcaacaattagtgttttttaacaaaaggacataacagtgcatagccaaaaatttattaatttttggaacttttagtttccaaattcttcttcattaaacacaagataaaaatacttaactttttaagacaggtgaatagaaggaaatttttgctgagcctcttctactttttatgttaaatattttattctatgctttttatcatggcttacacaaaccttcataatgttgctgcaatatatttactgactatcaatgctctcttcaaatttggtataggtatatttttcagcctttcccccttcttgtctccagttacaggcccttttatgggcctataacgttggttttctatctcaattcaaaattcaaaagaaaagactttaaaaatcatctttttttttttgccctaatgcttaatttagagcgtagcacatagatattcccaatatgttctcattaaaggtattgatctttgatttttaaaagtaagtaacaacaaaactgtgagagaggagcagctttttcctttgagaactgtggtttaaatgcagtgaggggtattaatgactacataaatgacttcctatttcagtgaagtgtttaataaggtctttaaaacagtacttcatagcatcctgctcttcaaagcaacatctgtggctctttttggttccaataagtgataaataacaacaggattttggttcacgtaaggacctaaaacaggagagttggttaagctattcatacatgttgctttgtaattgggctgatgtaattttattttattgtgttcaaaatttacactggtattttgtcaattaccttttttctcaacttacaaagtacatttttaaaaaagaaaaccatatacaaagcataggttgtgtaatataatgaaccagtcattattcttcttatctctctatttaaatcatagatttcaaaaagtttaatacgaattcatttgtgtgtgtgtgtgtgtgtgttataatgtagtggagaagcaaacttgatacatttaatgctgtaacattacatattgatgcattcataattcaaagtaacatgatagaaagaaacatacatgtgaaggcattaaaaacatttttgtttgtaaggattttgaaacttggaggatcaaataatataactcagaattctttctgtcaaaataatgtggaacaagaaacacactaaacaagagatatttgggaagttctactcagtccataatttttctcccttctctggcgactatcaccctccagtcaaacaatccataagcagagtccttgatatcatgtttgtattgtgtgatatttgcctctaggacaaggctgactggaccaagattgaggcctgattcaacttggaacaaacagatgcacttcctaaaatactttacctgagactcataaaatgagaatttgtgcaatgagtcattcttagtagcataccactatggagatggcctatggccccatcattcccatggcctgtaggttaaatttttcttgggttctaccagtagataatccagagtatgcacaaatacaccttgaattttgaattgtattttgtttgggtttctgtttcttgcaagaaagaaagacattattgatatttacaagatgacttaaaaatcaggtatattctaaaagaaaagatgagactacttgagataccaaaataaacagggaacaaaaatattaccaacatattatcgtgatgtagataggatttttttcaagaagcttgagagcatattagtattgcatttggtacataatctgaataggaccatacgataaagaacactgtacaatgttccaccaaagtataccttaataacaacaatagcttttataaaaattcttgttttatatatctagaattttacataaatgtaaaaaataatgtagatgttatatctcatttaaatatcaatataaaagttaattggctgatacaaatacatccaacttactcaacttatttattttcttttgagaaaggtaaaattagagaagtccagagacttatacaatgagtacatatctccaggaaatcataattatgaataatctgtcctaatttattgtgcataatctaattataaaagaaaatgattcaaatacatgtgaaaacactttacttccttatctccaggcctgttctcctgctctcgtctttataagaggccatgatatatgaattttatgttcattaatttagctcaattgttctgcttttcacatacattcctatatccataaacaatacataatgttgttgttgtgtatgtatgtgtgtatgttctttacaaatttacttgagtgcttggcatccttcattgagctaatgagctatccataagaatccatgttgatccactccatacccaggtagtatcgctgacaggctgttcagcctctaattgtattatatagctcttcttgcatgcaggtgtggttatttgatttgtttctcccagtagaatatgagtggaagtaatttgtgtcaattcagagcttcagattttaaaaagctaatatatcttctctgctgtttctttcccattctatggatgtatgcagatgactctgaggttgaagagatgcgggggagcaacaaaatggaagacgtctggatccttgcatcgtcacatgcaggaaagcaacacgctgccatggaatgccatggactgtgacatgagcaaacaataaatatctgttgtgttaaggcactgaaattgtgggtttggtttgctatgctagctagcattaaaagaatgaatatactatcacgctttgcaatcgttctacaactttcctttttcactcaatattatatatttgggttacataattattgtgagatatggatctaattaatacagggtttttcaaaagtggcacttttaacgttttggactgataattgtttgttcgggggaggccgtcctttgcattgtaggatgtttgccagaatctctgtcttctacctactagatgccagtacaatgctaccacttccgcagtaattacgataaaaaaaactgcagacattgtcaaatgtcttattcatggccaaactcatgcctggttgagaaccacttatctaatacactctttttagctgcttgatagtatttcaccacaggcatcaaggatatttattatatttttacactattgaacaatgaaaatccttgtaactgattttgagctgaattatgatacccatactagctgcttaagaagaagaaatgccttttcttcaacatcaataaaaagtaaagcataaaattatatagatctgaaaagtaaggaacggttaaaaagacaggagtagaatgtagagcactaggccagtgcaaaaatagaagctgaactctaaactgggacacaatcacaccttagttgttaatttaagtaatggatgcttctgagttaggaatattagctcactcacaccacaatccatcatcaggcaatcctttatgattcttaccttctccaaaacaattcctaccattcaactcatctgcaaagcctgtcagtgctccctgcaaataatacttcatgtgaggctactttctttccttcataagtgccactacccttgtcaaagccaccccgcaaaagtgaaagagcctcctcgaggtgaatggctttccagccttctggaaagctggctgagccactgatgatgatgtggcctttttattctaggtttagtttaaggattataaaaaaccagatatttatataaatattctcttgaatggaagcacatagatgattagttcaaattctttcgaagtggtgatgtaatatcccagttgaacagggtaaggtaaaaataaagattttactttctataactaggcagatctcacattgggcctttagtgtcatgggtgccattccactgggaaatctgatggaccggggaagccatatttccgaataggttatctgttcctatttatgtggtcatccagtttttgaaattttttaactaaatcaattgcaaacttcatctaaccttattgtatagataaacacaatttacttcggccaacctgtacccaacataaaactctgtatctcctgagatcttgccctctctatattcttctcactgcaaacagcatcagagtaatgcccaagtgtacatcccattgtgacatcccctcaaattgttcaatggcctcctattgaccttaggatgaagttaaaacactctagattcacaggtgtcccgtcaaactttcctgcctcatttcatggctccacagatgctggcctctatcatttccctaagttcgctaattcttcgaagcttaagagccattgtacatgttatttctctgtactgaatgtcttccccttctctctccctccaatttttatagttcagaggatctcagcgtaaatatcacctttccagaaaggtcattagaacattaaggattgtaaccaagagacaatagctgttggttttattttttattcttgtggcatatgccaactaacttgcacagtgcctaaagtcgaaaagggctcagttactatagacacaagcaaatatgacctgagctaccaacaaaattacatccgaagacaacaggaagacgagactgtgaggtttccaagtttatagacaaggtcagacaaggaagtcattaggctcgtctctgtcaattttgaacaacaaagttattatttctatcttgcaacaacaaaatatagtttttttaattaaaaaaatcttcatttaagaaattgctgcaggaaaataactttgaattgcaagtataaagaaaattttctgagccctagatgctctttttttcctttgaaaaccattattttcaaaggaaattgttttaaaacataattttttaaaataaggtgtaaacgctcattcacagaagagccctaagtcatgctacaataaagatgtaagtagaatatgggatttgagtcattttttcaatccaaggaaaatttcagaacaaaatatttttggaggtgtccaatatttgtttagtttcacacagaaagacactatttacattcaatatattttaaaaactgtacacatgttctataagattatcaataccaatttactcatttttcaaaaactattttttaagtgtttgtttgacaataagaaaattcttttaggtggtgtttcaaggaaggccacacattttaacataattctaagttgaggtgaattcataatataagacattttgatatctgtcaacaaagactctttacttgaagaacagtcattcaaggtctgtgtccttaaatataacattccagatagcttttaatttcaagtcttttatttccaaaagattttctgtggattatctattatagttactaacaaaataataattcacaccaggcaattatatcctggtatttgataaaacttggatgtttaccatttcaagaatgatttcctgaaaaagaaaaagaaaacagctgatattcaaagtcagccattttctgcagaatgagcaattatttaaaaggaaataacttttaaatgagcgcatatattccaggcacatattttctgctgcttactgaacaagtccacttcaaacataacatgacatgaataaaaaacaaaagaaaacaaaacgaattccaccccaaatgtgctcctccttatatatttctcaccttggtaaatggaactactatttattaaacttctcttgtcagaactttgtatcatttaagatttctgtcttcctcaccttcatttaatcaagcttcaagacacgtagattctaccactaaaaagtgtttttaaacagtgtctattgttactattctaatcaaaatcatattacacttatgactttataagtactacgacctcctactggtctttcatctttcctcagcctgttgatcctccaatccctatataagtacctctattcccaataaagtctctctgccacatgaactcacaatgagctttaaaaagataaagatgatgatgttattccgtttgactaaatctcataagcggctccttatttttttggttataaaatccagaatgctaaacacgaactataggatgctgcatgaggtaatccctgtttacatatctcccccaacccatgttgattcattcatctttcctcattctagctgtgcttgactttagttcctcaaatatacttgcttctttatgtctcaggtctttaatacatgcatgctatacaagccagaaaacatcttaccaccaccctcaagtaatataaactagacaagtgcatacaatgtctttaattcctggtcaatttttatcttcaagtgaactttactataagtgaaagcttttgtttgcttgatttatacatggtcacaaaataagctgccagaaagtcgaatttctttcctcctagcttaaaaatacatctacccctccttcatccttaaaaaagaaaatgcatcttcataaaaagattacaacttttgaatataaaagtcatgtttttcaaacaacggatatattctcaacatatatgtatttcccaccaattatgagacacaacaaaaaaagaaaatttcaggccaatatccctgatgaacatcaatgcaaaaatcctcaataaaatactggcaaactgaatccagcagcacatcaaaaagcttacccaccacgattaagtcgacttcatccctgggaagcaaggctggttcaacacatgcaaatcaataaacataatccagcacataaacagcaccaatgacaaaaactacgattatctcaatagatgcagaaaaggccttcgataaaattcaacaccccttcatgctaaaaactcttaataaactaggtattgttggagtatatcttaaaacaataagagctatttatgacaaacccacagacaatatcatagtgaatgggcaaaagctggaagcattcactttgaaaacccgcacaagacaaggatgccctcgctcaccactcctattcaacatagtattggaagttctggccagggcaatcaggcaagagaaagaaataaagggtattcaaataggaagtcaaattgtctctgtttgcagatgacatggctgccatttatccccatgtaatgccttctaatcacactgatgttctcgttattttgtcttgaattaaaaagtctttttattataataattattatttcactggaaaaagctacatataaataaaaagagaaatacttataattttattgccaagagatagacacccaatttatttgaagactatttccaaacgacagttttttctgtgtctccgtcttcatctttcccacattctgcttcgatatatgttaccctaaaaatcctactacatatattgttttgtaactcacttgtaatatttttcaatagtttctggccatgtttctacttttatatactgaaacaattcaataatttgatggctgcataatttgctattttataaatcttatataatttatttgaccacacttgtattagggaataagatgtaacccatttgtatattcatgcaaattatatatgccaattttaacatttaatacacattgtccacattatctcaagcaaatttataagaatgtatgtattccactactaatactgcacaagactttctattttcatcaatcttaggagtaattaccacggtgggtttgttttcattcccttccccaaaacttccgtaacaatctttggggttttgtcacatctcccttcacacctacatcacctttaaaaccaagagttaggactcattttggaatcatttttttatacagctcaaagtcagttacattatatttagtaccattagaagatacaaattttcctcaacactttctgggtgttggaacctcaaaactattttaaaagagtagcgaagataatatctatgttgaaatgaataaaatagatctatcatgaatatcatgttttataaaacagaaatgtatcaatgaaagatcataagttaacactttaaaatatatgttatttataaacagatatacatattcggaagatcttcaaagtagtacattgattcttatccaaatttgatttgagagctactggttttaaatttgtaatacaaattacgatggggtgcggatttcctaggccagttttttatgtacaattgaatgtagaaaatctacaaaaaaatagtaggatacaatcctggattttggattctggagacagtggaccacattgtataggtgattgaatgaatgaaatgagaagatatatagatgaagaaaaaaaagaaagaaaatatacaaaggaggagatgattggaggaaaaacagatgccaggacaagattctgaagtatatatttttggttttgcttttatccctcacctattaaaccctgtttcatttgactcctactctattttctaacctcatctcccattgttgctcttaccattgccctctctactccaaccacacaagtcaatttttctgcttctctttttttagtccattcctccctttgtgcttcctgtttccctatatagaattctgttatccagatcatcacatgtataggtctgtctattatctcatgtatcagctcagctatcactgcttcatagtggccttcccttttctttgaattgagaagcccttaaatccagattcactcactataggttatgtgattatccctcaaaatcatattctttaaatatttgatttttatcttttctcactagtaagtatgctctgtgaaaaccaggcgatgtctctttttcaccctagacctgtcagtgcctaatatagtaccttggctatagcaggttgtcagtgactcttgcattcattgagattagaactgagctacaagtgacagaaaatccaaaataaccaatatcaggaacaatggaagtttgcatctttctgaaataagaagagacagttgagaggcagtacagtggctccatgatcatcagggacattggacaatttatattattagtttgtcttcttcaacatacaacttccattttgtagtccagatggctattcaagctccaatcatcacattgccatccaagtaacagtgagaaataacaaggaagataggggaagatggacttctcttcctagaagtttcacacattaattcttattatgtcctatcagaaccaggtcacatgatcatacctagctgcaatggaggatgaaaaatttaaactttattgtaggatgttcatttaagccctctctcgatacctgcctctaggctaaacatataaaaggaacccgtttctcactaactcaccccaaaccaataattcatagtgtagctaatattaagtatgtgtccaaaaggtagataactgcccaaacgttttatattcttcctcaccaagaggtaaagggtcaacttcattcttctgcatgtgaatctcaagttttctcagcaccgtttgtttaaaagatgattctttctcattttcatggtcttagcctctccctcatttatgagaggaaggatctgcgctaggtgtggtagctcaggagatacagaagcagccacatctcttcagctatgaccagacgtggtgataagccacagcagcttctgctgataagtaaaaagaagaagagaatcacgtagaagaagcaccctgtttttggccatgtctatccagagtaaagtttctgtcacacagagctagagagagtggggttggggtggggattgttgctcaaatgtcattaactttcactgttctgactgagattttgcaggtttttttgttttgaataaatatttctccatttgctatatgctcttaagaccatttccagagactttccatggttattttattacaattttcaccagttacagttgttttactcgggacagcatccatggagcccctgacactacacactaccatttcagaagtgtttctctccaaaatgttcatgtttatatttcgccatagttttttagttaatatttcacaaacttgtaaaatgtgagtatcttcaccccaaccttcaggactgcagtggcagaggccatgaataggaggtagagtagattgatttagttttaatttagaaaaatgaactcatataagtaacaattgcaggtaaaaattaggatttagactttgcatttgtaggctctgttttcttatatttattaagtttaatatatttgatactaggtagtaaaatgtttactaccgaaaaaaaaaacttttgccaaaatgtgtcaaattttttattttatagcaaatactcttctagttaacatatattttatcttcagtgcccagttatttcagcttcattaagagaaaaaaaaaagggaatcaaagagtaatatagtgcctttttgattttaagactagctcttattacccttggcaatagattatagaaatcatacaagcagtatatacaatttcaaagtcacacacaaaagtatattcttgaattatttaaaaagtttcaactcacaaatattcactgtagaaacatacaaaacatcgagaatttaaaggacatatgaaaacaaccagaaaagagttaaagcatggattacgtttagttttacaatgaaaagcaacagagactttgaaattaaagatttactatggattgtgaaagctgaatgctaaatcttaaggaattttgagggcatactattaaacatagcccttgttaaaattaaataaacttatgattaaataaattatattaaagcaactgtaataaatgttcaaaactcatcacttcttaattattttactacatttcactgtcgtctacacttgtgaggttatttgtatccttttatctgtatggtgaaaatgctatataataattggccactacctatctcatcccagctccacactcagcaacatcatgttgatagcttgaaactggatgtggttgaagtatttacaccacagaaataagcaaacactaagaatcatagcttgagttctttctcactgagctggtggttaaaatatacctacacagtacacatccccaaagagacatatatagagagatacagacataagtatatataatataaatatatggagataaagataaatacaaatagtgacatagatatgtaaattcagctagctatatcagcaaggtaaatgagtaaaaactgaaaattcgtcagcaactcaagttatatttttagtaaaaataaagccttgttctaaacaaattcagaaacaaacacagagactaaccagtgacaactggttatgcaataaacatcctgacaattgcggtgtgcaataaacagacccacatctaccattatttccacagggatgttgtaaatccattcactggccaaacatttactgagttattgactactccctatcagtttctgtgctatctagataaaacagtgagtgacaaatagtggctatccttagggagctaaaattacacaaatggacacagaattctatcaaccgtatgacaagagacatccatgggggatgagctaatatgtgatgacaaactattttgtgacaaatatgatactaaaatatttatttgcattatctcacatatattctatatgaattctgatatgtaactatcatttcttcattttacctatgagatccaggtaagttaaatcatatcacattatttagattctatatccaatcagctgttgacttttatccatgtctttcatagctttattggcttttctcctagtaatgctttctcttgtgaaaggtattccatataattattaaagcaaggttattccaagttaaagtaatccattgtggtgatgtctcccacatgaaacatcactgtctgaatggagcaaactaaaaaataaataataaaaggcagctttttaaatttaggtgacagagcacaagcagattctataaattatagcagtttcataaaaggtaaaatcccaagaaaacctctcagaactattcacatttttgaatttatgtcttctagggtacactgtaggatgtagttaaagaagaaaaaagaaaaaaataagaggtttttcaatataatatgaattccagttttatcatgataggagaatatagactgtaggaagtataatggtaccagatgcttttatttgtcaattattactaaattttagaaaaaagaaaaattctagtttttgagtcttccagactgagcacccatttgacatacaatttaacttaccaaaatatgatagctacgttatgaagctagacacaatgatatgtttcaaatgtataataatcagaaatatcccattatttggttttatataacatatacatagcccatatgtcaaaggaagacacaaaaaatagttttagtacctggttgaaatttttgattaaaaaatttagctgatccttgagaaatttaactgaatctaaacttattcacaaaagcttacattcactttggcttatttgatgtttagaaaattattttaatgattttattcttgcagcatttgctgaatagtgttattgttaagaataacacctctgaagtgatacttcctgagatccaatacacttactgttttagataacttacgctgtagttttcatctctgtagatgaggtgggatacactaatacctacttatcaagcagtctgacaagttttaagaattattatgtccaaattaaatttaaaccaaattaatagtatatgccaaattgtgaatgtacacacacacattagtgtacataattatctttttttccaaaaatatttaagtaaaagaacataaagtttaaaaatagactttgatagtagacagactttttttttgatgaattggtaatattcattcttgttctataattttaaataaaaagtttgtctcattgtatctttaaaaatacgtgttggtgaggatttggagaaaaggaaaccctcatgcactgtttgtgggaatgtaaattggtacagccattacaaaaaaaatagtagggaggtttctcaaactattaaaaatagaattaccatgagatctagcaatttcactgttgattatttacctgaagaacatgaaattagtatctcaaaaatatatctgtactctgacatttattgctgcattattcacaatagccaagatatagccacaacctgtgtttgtggatgtatggatgaataaagaaattatggtatgtatacaatgaaatattattcagccataaaaagaaggaaatcttgcgatttgcaacaaggtgaacttggaggacatatgctatgtgaaataagggcagaaaaaaatgaaagacaaatgttgcatgatattatgtgtggaatataaaatgttgaacttatagaagtagggagtagaatagcggttgccaggagtggtataaatggggagttgttggtcagagagtaggaaccttcagttatagagatctaacgtacagcatggtaactgtagttaatattaatgtcctttatacttgaaacttgctgagggagtagatcataagtgttctcatcacaaaaaaaagagactactatgcccggtgatggatatgttaattatatcaaaataccgtgttgtatatcttaaatatatagaatgtttttatttctcaataatacctccataaaaattaacaacaaaaaagtatccctaaatgatttcaataacatatcattacagcagctacaaaaaggacaaactgatatttagccacaagcatgtgatgatcaactgattttcactattaagttactgttctcttaccgtaagaggaaaatagttccttcatgttttaataatcccatttcatccagaaacacagagataattccctgtgttagccgcacatatctcaattcttactcaaaatttaattaatcttcagtgatggaaaacaatttccttctattaagaccatatcattgctgaacgtctttaatttcaagaaccattaacaaaatttcaaacaatttatgttatttaaaatagaagctgaaaaaaggagaaaactacacaaatattttaccatcacaacaaatgtgaatcacagattcaatatgtgattcttaaacacatttcttaaatatgtttgctgttttggctgcaaaacaatcgtcaatgttgagcgtatcggacactttaggaaaatctttagtaataacaaattctattctcttagtatcttatttcttgctgatactctgtgcctatcctaataagcaggggatggctacatactgtaatcactcaggaagataaaacagccaacattttgagtgttgttggtctcaggaagataaagcagccaacttttgagtgttgttggttgataggtctgagagaaaacagaacacagtaaaacattcaatggctcttagaacatctgtccaaaagtgacacagttcacttcttcgcacatttcattgatccggcatgtcacacagccagactcaacttcaagtgagtgcggaagtgattccacgtaccagaaaggggacagaagcggaacagctatcaagagtcttaatgtctaccacctccacctgtatcagataaccacaacttcacagaatatatttcataataggtacagagaatacataacttaaatgaaactcatcattattaaaaataaactttccaaatattttctctatttattttaaatgtaattaaatctttataagcaaggtctgcaaatttttattctaatttttttttcctgagagtaagtggttattatgttactctatagttgaaaaccaaaatgagagaaaagaaaaatgacataatcagagttagagagatataggtaaaaaccctgactttttcttttggtacttgtaggactttgcagaagacttttgatctgaatggcagtaagtttcctcaggaaaatgaaattaatatcatctaccttaaataggtggttatagtgattacatgagctaatgtttatacaaatgctgtcttttactccttcccttcttagcttctatttgaaaaaactttggtaaggagctgcagcttttcaaaggggccataaacttgactccgtgcagattctaaggaaggcctagtgaggaaagatgggctaggtagttgcttcagttctctaaattatgtgcaagaatcttaaaatgaaatatgcaagaaagatacagtctaggggtggacaggtaaagaacagggagaggtaaaggcaagaatatttggctgaataatggaatatgtttttctagccattctgacaattggtagatgttttacattgtccttttttacatactgctgatattttcgactttaacttttcctccatgccatttttacaattacagtttgaataaattttaataatataaaagtctcttcttgaattttgactctctccactttcccattcaccttgatgtttccgatgatcctttaactgtggtagcagttgcacttaaatagcatgctgcaaatcctacagtgtgagagctctttctttctttatgttaaatttctaaactgtatccactagagacagctcagaagagacaatgaatactaatcaaaagagaaagaatcacttggttgtggtcacgccttagcaagaaacccctttaccagaaaagacaactgttttacatgctacctatatattcccagtggaaacagccacttcacaacgactttaaagtgaagatgaatgagttttatcattgcttttttgtggtgcataaactagacctgaaactatccagtattttatgattgttgcattgaacatgcaaattagcaaatattagctttgatcaaataccacagccacacccagaatgcttgtactagtttaaagccatcattggcaaaggccagaattctttgtttttaatgaagaacatataattcccataaaggcatgagattatcaggcacccatgtcaatatgatcaggtgaaaacttctggttcatcctcaactaaccttttcctatcttgctgatgaggaaaatttaatactaagctaactgtggagacaaactataactctttgtaatgtttggatgccatactgtgattgtttgtgtcttctcaaacttcatatgttgaattctaatcaccaagatgactatattataaggtagtgcctttgggaatttattgggtcatgagggctctaccttcatgaatgggattaatgcccttataagagaggcccaagaggccttggaagctcagtgagcgtgcctgcaccttgaccttgaacttccccgcctccataactgggagaaataaatttctgttctttataagccaccctgtttatggtatttttgttacaccagtctaaaaggactaagacactgatttggggaagattttggcagtaattgctgtctcttttacatactcttccccaatgtaaacttctataatctaatcaagggagtttaaacataatagccatgtaacagacacagtgtaaaatatcaaagattttttaagatgtagaaccagtcgcgttagtattgtggcttcagggacaatgtatttcttatagcaaagagaccaattaacaaggttcgataaagcagtatccatgcactcgctgtccttcagtattttgcatgaagccaaaggcagaatatgctagaagtagaaaagcaggaggttaaaataaccattatcaccaggaccctgacaccactcaaggccaggcattgtctgatttagggagaagcatgagtttccttccaagtggtattacctgtaaaaaccagggcaattcactctccaggtaaggccttaggaactgtacgtacacatttttccatctcaattttgcaagcacctcttcaaaatagtgtgtggataccctgcccactccaaacagacagaaataggtggctctctacataatgcttagaaattatacttcatggtatatttttttttaaggaagacatgccaagcataatgatcttatgcccttgtgaaactttttaaaattgtgaacacagtgtatctcattccaattcgattttacaaaattatgcagtaagttttttccctttgttgtaagaaaatatttgtgtcttagtccactggcgccattataacaaaatatctgagacaggtaatttataaacaacagaaattaattgttcgcagttctgtaggctggtgaggtgtctggtgaggacccagtctctgcttcgaagatgatgccttgaacgttgcatcctccagagagaagggatgctgtgtcctcccatagtggaagtgatggaaaaatataagagcctagttagttctcggttctcaccagcctttttataaggtcattaatcccattcattagggctctgccctcatgatttaatcacctcctaatgtcctccaccttttagtactatcatattggcaattaagtttcaacatatgaattatgtaggacacattcagatcatagcagtttgtaagataaaatacatacatgacacatttcatcatgtaagatattaagttttaatattttgaaaaattttattttaatattcatttttctacacacatatttcatagtattaaacatattggctatatatttttataatgtgatcaatttttattcatcttactaaatattcttgaaaacataattttaataagtgcttaatgttccgttgcaacagatatgccaagatttgtttatctgacccttatttttcagctacttaggttgctggtcatttccacttttcttaaaagtaacatagcaaagaataaccttgtccatactatttaatcatgtctttagggaagagtctcagaagacaaattgctgggtcatagggtcaaatacactctttatgcatattgccaaaatgctttcaaaaaccattagactgatttataacctcaccaacaagaaagggcatgcccacttcactgactcttctactgtattcaccatttctaggttgataggtaaaatttacataaaaataaatttaaaattaaaaactactgatttagttattctactaattccgtgagcatatcttcatatttcttgggcatttatatttcttttgcggtaagctatttgttctctttactctttccatttttctatagtggtattagtagtgttgcacattttttaaagaacttaatttttctagagtagtattagcgtcacagcaaaattgagaggaaggtacagagatttctcatatatcccctgcctccacacacgtacagccacccacgctatctacatctcccaccagacgggtacatttgttacaattgatgaacctatattgacaaatcattatcaccaaaattccatagttaagagtaaaggttcattcttgggtgttgtgcattctatggatttggacaaatatataatgaaatgtattcacaattatagcatcattacagagaatttccctgtcctaaaattcctctggactctacgtattcatacatttccctcacagcccctggaaaacactgatcttttaactgtctacatagtttttgctttcccagaatgtcgtattgttgaaatcatatagtatgtagattttttcagatttgcttgttcactggtttcctctatgtgtttttcatggctcagtagctcatttctttttagcaatgaataacatcttattgtctgaatgttctacatcttatttatccattcacctactgaaggacatcttggttgcttccaaattttggcaatgatgaataaagctgtcataaacatccatgtgcagggttttgtgtggacataattttcaactcctttggtattttacattttaaaattttaagttatgtggtatatataacaagccaaaataagcttagtttcagttaagaattatggttttaaaatcttctaagattaaaatgataaaataaagccaacattcttctttccaccgaagagacttacatataatacaaattcagaagttttatgtctcctagattacacaaatcctgggtaataggaatatgggatgggaagaattacaaatggattatgtagatacttactgatatggtttgtctgtgtccccacccaaatttcatcttgtagttcccataatccccctgtgtggtgggagagacccagtgggagataactgaatcatgggggtggtttccccatgctattcttgtgatagcaagtaagttctcatgagatctgatggttttataagggacttccccctttgcttggctctcattcttctccttgctgccgccatgtgatgaggatgtgtttgcttccccttctgccatgattgtaagtttcctgaggcctccccagccaggctgaactgtgagtcaattaaacctctttcctttatgaattatgcattattgggtatttctttatagcagtgtgagaatgaactaatacacttaattttttaaatgtctgaatatttatcatttcaaatttatttaatgtcttttgtttcctctcttaatataattttatcaacaaatttttccattaaatcagtgaatcttctgaagttatttattataaatatgaattaattcctttcaaatttattaatgaattttaatataatttaatatatgatgtaaaatgatgttatattttagatttgcttgtaacggtcaccaatatgtaaacagattctctctccaacaattagaaatctaaactatactacaaggctacagtaaccaaaacagcatggtactggtaccaaaacagagatacagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttcctcacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgggatctcatcaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggcgggactgtaaactagttcaaccattgtggaagtcagtgtggcgattcctcagggatctagaactagaaataccatttgacacagccatcccattactgggtatatacccaaaggactataaatcatgctgctataaagacacatgcacacgtatgttcattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaaccattgcaaggacaaaaaaccaaacaccgcatgttctcactcataggtgggaactgaacaatgagaacacatggacgcaggaaggggaacatcacactccggggactgttgtggggtggggggaggggggagggatagcattaggagatatacctaatgctaaatgacgagttaatgggtgcagcacaccagcatggcacatgtatacatacgtaactaacctgcacattgtgcacatgtaccctaaaacttagagtataataataataaaatttaaaaaaaatgccaaatataacttcaaaaaaaaaaaaaagaaatctatacctaatttaggagacaaaacaaactaatgtcagaagtttgtttgcacacttctgtaattaactacaaacatatattcaagagtattctcttatcatttcattctatgttataaaaaaccttcagtctcataagtcacattatagagcattacgttttcctcccatggtgaaaaggattagttcttagcaataacttaagaacacatcttttgtcagtgtctctgagggataaatatttcctggttgagtgtttatgcacagaggaaaaattactgaagtctgtgcccaaatatagcttctgtaaacttgaaaaatataaaagagaatttagtgaggaaaggagacagagagtagctccttttggactataatacaaacacattttctaagaactaggccttggggatcataatcaactagcctgagccacacacaatggataggtatttctgactggcactttttagctgtaaggcatgacatgaaattgcaatgagagagctacaaaaaggccatagagacaagtatccagcttaacctttctccctatgcagttgtcttctttaccacagtgatgctggctggtcaatttagctcctgcttgaatacttactatgaaaagaaactcttgctttatgttacatgtgcatcattcatttagacaaatttttaatgcatttacttattgaagtctaaaggtacacaaatgaagaagatgtggttcctgatcttgcagtttccagtttataacaaggaacagaaatatacatgatttaatataacgtatggtcatagtagagctgaaaatctgaagctttggctaaaatgaggaaggagtacctaaatgggcctggtatttgctaaatgtatagagggaacaacatttaattgaggaaataagtaggagatttccactgatagaatggtagaagtagggctgtgatgggtgtgggggacatggaggggaaaggcaaatggcacagaggcttgaaaactcctggcatgtttgggtgagaggtgagagattctatgtggctacatcacagcaatataaatgtcatgttggaaagtgagtctggagaagaaaattggggcaaacaatccaaagtctcaattagtacaaagccatggggacccagactctgtctctgtaatactgaggacagatgcagcatagagtagatattacaacaagatactatggcgctaccctgcctaagtttcaatgtgctctcaaatagttggtgactttggacaagttgtttatccccaccctgactaatacatgctctatgcctcagtttacttatctgcaaaatgaggatattaatatttagctcattggattgttttgaggagtattggacaaaattcttttaaagtatgtaaaattatatccttttaataacaacattgattaaatagattccaagtatgtattggagcagagagagtccagatgatgatccctgaaatccagcagtggccaaaaataaaagaggagagaagaatgcatgatcattgcaactcgagacagatttagctattagaaagttctttcttatattacacctaaatttgctctccttcatgcaaagaattcaatttctactggctggccctatttctaccttccacctaatagacttacatataataaaaattcagatgttatatttttcccagattatatcttttttaattttgtaaaaataaataaataaataaaagagtttgacatttcactcacgagtcatccttagaaagagtaaaagatcagaggctgggcacggtggctcacgcctgtaatcccagaactttgggaggccaaggcgggcggatcacctgaggtcaggagttcgagaccatcctggctaacacagtgaaaccccgtctctactaaaaatacaaaaaattagctgggtgtcgtggcatacgcctgtagtcccagctacttgggaggctgaggcaggagaatcacttgaacccgggaggcagaagttacagtgagccatgcgccactgcactccggcctgggtgacagagcgagactccatctcagaaaaaatataaatatatagaaataaagatcagaaaggcccattgtaagtactaatggttccagtgagatacagcaggcagcacagtaagcagcgcctctattgttagggtagaaagcagtcacaggcagaaattcaataaaaataagaagaaaaatattttagagtccccaaatcctacctccttcaaaagttactcatccaaaatcctttttaaactgtaacattctgtacagacaccagtttttcaaatataattgctaagatgtgaggcataaacataaatctaaatttcattgagtaccacgtaatgttcagctattatcatacttggaaacacatggataaaatgaatgttgaaatagtcatgactctggtatgtctaccaatgcgcagttgatttatactgtcatttattgtgaatgtgccataaatgacaagctacttatgacattgaattgaaccattctttttggaagtctctatgccagacattgttctaaaggctaagagtttaaaagattcaaaaacacaatagttccctagtttgccttccttcctacatgtccttgcctgctctcctaactcctaccccagtctttgcccaactttggcattttcccaagaaagattgcattccaagaatcacagtggtatttggaaatattttgagatttcgaaataaataattcttccttttaaaacaaataatttttctgagaatcaattaatcgtctaactttaaataaagtaaaaatggataggaattaaactccaatatattgaggcaaacagtctttattttgaaaatcctttttaaaggtttccacaaataactctttaaaggaaagggctaatatttccttcaggaaaatttacaacaatctgttaaccaaactagatcttcaagccccttaccaattcctctccccaattgagtgttttccaaaggtccaatttggaattccttttctttttctttttttcctttctgtaaagggtgagcatacttaggaaattagttaaaattactccattgaatgctctgttgttccttagtattgagggaaggttcaacatatgttaattttgggaatttttttagatactgcaagactatcacatgtagcttagtctcacagcaaggatatccacacaacgtgctattagcaagtaggatgccagccgccacagaccagtattagcctaataggatgaaagatattttgatataaacaaacatgcgagaccacacagtcagtaaacattttatagacaaaaggagaactctaatgacattcatttggcctttggagaggatgcattcggggcatttttcatgttataaaggataattgaatccaaacagtgttcatatgggaacactaaagctctaacagtacataacagagccaagtcagactttttaatatttatatgttcttttagggaaattgttctggttcctgcagatgattaataatacctgctgcatttgcataattcacggtgttaaataattaacaggattataattatattcataattctttatcaattgaagttaataactttggtctgctctagcgcgctatgttattgaactaagatctgtacttcaaaataatgattctagttaatattagcaacacatattacatatctagccctttctttatattccccagtcagctttgacaaattgagtatatggtttaagtcccttaatattcagtgagaagaaatgcattttaaaatctggaaatctgtctgtatttaaacataaatataaataaataaatgaacaaataaataaataaagagctttatatctatactgaggtgtataccatatctatctttatatatatagatatgtgatatttatttttactgcaaagagatagtaaactttttattttagaataggttacaagtaggaaacaaatatacttaaaaaataataaaggtgtacaagatgcaaccatttgcataaaatctaccagtaggtgggtcactcattggccttttgtgaagagatatatttacttcaggacctgaccaattagcctagatgaatattatatttttattacaagtatgtggtgtgattatattattattacaaaattataacaaaaaaagtaatgtagaagtactatatataggaggccttcagcttgtatcccttactcatacttccatcaaaaatgaagcatagaagtatttggagtattgatttattttagtcattcattagctatcatggtcttatccatgtctgaaaatcaaatgcaagatgtactttagtgaagaatgcaataaaaattaatatctgtgcttgtggggtaacaaagttaaaaccaaggcacctttttctactgaaaaggtgtatgaattaaaataacaacaacaaaaaactactatataattcagtctccattcaaataacttataaaatagcttggatgttttcttgaaacatcaatattattaagaagatattccaatacagaaataatttattctgtataaaccgtacttaaaaatgcatggagcctattgtagctgcctaatggttttgtaatatttttgttgaagtggcttaagtacaaaggtttaattgcttattataaaagactaaatattttatatcaatgaattaaatttaaaaaatatctgccattaccacaatagtccagtgggttgcagataatctgagtcaatttaactctcttatcaagagattctgcccagaaaattagcaaccattattatgttctgaaagaacacaaaaggtctataataacattgaaccaattattaaatgtatatttttcttctaagagaagttcgcttctttaaaatttggattacaatatagagaatatcacctaaattattcattttaattaagtcatttcctgattttgtcttagcagatacagtcaattaagaaattatccatattagccttgcatcataagtaagccctaattctgcaaaaattgagtattgtttcatttcctgattctaaatttgcaagccacagaaagtcagatcaaaaataaagattacgagtctaggcttatgatgttaatttagtggatattttaatttaaagatctcaagatgtccctaaaacattctaaaatttttatagctgtaatgttgacaatatctggcatgggatttgaagagattaatggcaagaagagggatttttatgttgtttcatgcaccagagaaaatgaagctaaagggattttgaaaacaagaatgaatcgagagttttgctgttctaagttatgtaaagatatcatggactttatatcccagttcaatgtagaacttcataattttataaatatacatatatacataaatatctaacacatatacatatacttaatataattcatgcatatatatgcatatatacatacatacttcatactgtatatacctactttaatatatagatacacatatgtatgcatacacacatacacacacttaactataatatatatatacatatgcttaatataattcatgcatatatatgcatatatacataccttcatattgcatatacatactttaatatatagatacacacatatgtatgcatacacacagacagacacttatctataatatatatacacctgtctgttcttaccacagatatattcctaggagggtggtagttaaggtactaaagtagggtcatgtaaaatgagattttagtaaattcagaaagactttggaaataatctaccttatttacataaaaaataatatggtgaaatagcaaacaaaatgatcgtatgtctgttaaaccaaatattgtattgacattacttacgaatactaaagtctgaatttttttcttgttttttgctgctgtgttcataatgttatgatacacgatgatctagtacaaggaatttcttgaaagcatatttcaagaaaatagaggtaaagggctctattttatcaatgccattagttactggccacctgctcttatgcgtagggttctgtttaggatatagacatataaataacaaaaatataaatacataaaaaagccatttgccaagtgccaaatggtgcagggagttggaagtcggagattttatcattaccatggctagcataataaaaacagaaagaaaataataaggagatacaaaacagatgggcaagaaaaagaattttcaagaaatgtgaagggaaatagtaaagagaaagactatttaagatgaaaaatgttaatatgagaaaatcaaatgatgaaaaatagcaagtttttttttttagcaagagaatttattcttcatagaacctgtatgacatttatttaagaaacacagaatggtgtcatttcaatttcatgacattccttgtactggtggtacaattttttatacacaggaataaaaaaggaataaaaaagtaaaaggataaataacatagttgagtcctgagaaaacacgggtttgaactgcatgggtccacttacatgccatttttttcaaccagactcagatcaaaaatacagtattcgcagaatgtgaaacctacgtatatagagggccaattttgcctgtgtgcgggttctgcagagttggctgtgaaatgtgagtatgttcagattttggtatacatgagagtactggaaccaataccacgtgcatgctgagggacaactgtatatagttgggagctgtacaaatatataactttactcatgtcttagaacccaaatacagctaaataatacacctgcataacttgaatgtcgttctgggtttttagtactgttggaaagtgtagaccctacactatgcaagtgggttggatgaaggatgacaatgtgcagtcaagtcttgttattcactgtgtttctataaagtcactgtgaacactgaattagtgaatactgaagcattcctcccaggagaaatacaatgatagatttctgggagcctctgctcataacatttttgtgaaccagcaatgtataatcccattttgcctgtttttctgtttaaaaacatcttattgaatatatattattgatccattaacattcaatacacagccaacagcactgtaactcaagcctgaaggaaacttacctaaggaacctattttctttctaaggtacttcacagccttcttaagcttaggaacactagacagaaattcaccatcatgcttggggccatttaaagcagcaaaatcaccaagaaaaagcataaaaatatgaaaaacatagcattaaatacaccgctgaaaggacacttgtttaccgtatgagacctgaagcaagaatgcagagtgttccttttttgatctcagctgggaacatgtgtggtgggtgacttaaatttttcaccactctatgcatacacacaaatggctgtgaaaatgctatgagcattgattttagggatacaaattaaatttagcaagttttgagaactcccaaacacagaatgtgtgaataatgagaaccatctgtacaaagtttcaatcaatatactgcttgattaggccctttttataaagcactatactgtttttagttgcaaatggttaaatcctttcatcccatttggttatggtgtttgtacagaaaactaaattacagacatgtgtattgttgactttctctaattgcccttttgaatgatctgagcagagatcaactgctggaccaaattgtacgtcgagattataatatccaggttttgtcaggcactatggttaagaagtattgtcagttaagatgtactgcaattttaagcaaaagatttttttacatgctcaatctactaagtaaccaggagaagacaaatgtacaagatatttccaagagcattcttgttaccaactgaagaactgtattaataattcagtcctatacagtgctacttagaacttcagtgtcttcttgttaagcgaagtggatgtaaaaaaaaaaaaaatgcaaaggaatgtcataaatgcagtgaatacaaagctgaatttctaaaaagtggagcttgcaaagggactgtaggtgcaatttagtttgaaataggtatgaaatcaaaattttaataacaagtgtcactttgtataccaaaacctgttcatcaatataatcaaacacctagatatccatctgccttgatgatgtttaccatgaatttcataatcccaagtcaaacccagtgtattctactcacatatttgtgagctgtcattaaaggaagctagaacagaatgtagtatgtcatatatatgtgtgtgtgtgtgtgtgtaatgtgagaatgtgcatttatgcaactgagtgtgtgtttgtgtgccttgaggttaagatgtacaagaagtaagcatttggaaagtttgctttgacattacacacgcacacacacacacacacaacccccatttatgtatatatctacacaaacatagacataataattatattaaactctactagtttcctattgctcatataataaattaccatgaacttagtgatttaaatgtacatatattttttatcttttatttttttgagacagagtctcagtcactctgtcgcccaggctggagtgtggtggcacgatctcggctcactgcaacctctatctcccaggcccaagcaattctgatgcctcagcttcccaagtcgctgggactacaggcgtgcatcaccaccccaagcaaatttttgtatttttagtagagatgggcttttaccattttggccaggcaggtctcaaactcctgacctcatgtgatccgtccaccttggcctcgcaaagtgttgggattacatgcgtgatccactgtgcccagcctgttttttttttgtttttttttttttttttatctttcttagagttctggactaaaaccaaggtgtcaatggggcgctgttcattctggagactctaggggagaatccatttcctagcttctagaggctgcctacattccttgattcatggcccctttcctccattttcaaagcaagcagtatagcatcttccagtctacatcacattactctgacacactgcttttcattccaacatctcctttgactccttgaaggatttttttcttccttttttttgatacggagtttcactcttgttgcccaggctggagtgcaatggcgtgatcttggctcactacaacttccgcctcctgggttcaagcaattctcctgcctcagcctcccaagtagctgggattacaggcatgcaccaccatgcctggctaattttgtattttgtagtagagaaggggtttcaccatgttggccaagctggtcttgaactcctgacctcaggtgatccacccgcctcagcctcccaaagtgctgggattacaggcatgagccaccgcacctagccaccttgaaggatctttgtgtgtttgtgcttatttttaattggttccatccacataatccaggataatcttaccatctcaaagtccctaatttaatcaaatctgcaaagtaaactttgcctttttatggtaaaatattaacttaacgggactgggttgttcaaactctgtacattccaaagaaatatctggctcttgactggcttctgggcaataccagatagtttattttaataatgtatggtgcagcttttaggttacactgtatcagtttgaactctggagaggctggagatgactaaagtcagccatgtgagtgttccatgcctactacaaactccaatacaattctagacaccaagacttaggcaacttttcgttggcaatacgatgtgtgtgttgtcacacatcactgttgggataattaaatgctgtccagatgacttcatgaggagaggaaaactggaaggtggcacctggtctttcctgaacccggttgtatgcaacttttttctttgttcacttcagtctttatctttttgttgtaataaactgtaatcatgagtgtaactgcttttaagaattatatgagtcctcctaaggaataattgaacctgagagtagacttgaggactcctaaatttcgccatataaggcaacatattcatagcttcctaagattagaacatgtatgtctttgggggatcattactatgcctacaacagtacataaaatacatgactcttgtgtagaaacttcttcaatttatttgaccagaggactagttttttttttaatattgtcaaaaaagcttggaaacatatgttcctttattgagtcaagattcagttttcttaagagatttttatcaaatgttttgcaatatacctcttgaaaactaccctttcctatatgtagaataaaaattaaaagcacaattaaaagcaaaaacctgtcatattactttccatgtttgttatctagtaaatgactctgtaatcaactatttcctagcaataaacactgaaaaacatactcaactttcatctaagagtacaagaagtaatcaagggaatgggaaaactcaattagctaccagagactgtaaaacatctgttctgaaaaccaaactccaacaattcaatatcaatatctttaaagggataaagattattaatgtaaaattgaactaggaaagatgaaaaacccctgcactaattctcaattatattgggtttaaaggaaaggcaggaataaatcatatatacccatagatggaaataatccaggtatacatacacacacacatacatatatgaaaaatctataagcgttaggttttatattagtatccatgatctattttgagttaatgtttgaataaagtatgaggtgttcaggtcaagtttatttctctgcctatgtgtatccaaataccctagcatcatttgttgaaaatgatagtttccttcattgaattgcttttacacctttgcaaagaatcagtttggcataataatttccttctatttctgggttctgtattttattacattgctccatgtttctgtctcaccaccaatatcacattgtcttcattactgtagctatatactaaggtcttcatgttgagtagagcaattcctcccacattaatcgttttcagtcatgaaatctatagatcgatttgggaagaattgacatctttactatgctgagtcttccaatccatgaatgcaatatatccctgaaattatttaggtcttgatttcttttatcagcattttgtaattttcaggatatatatctcatatatatattgttaatatcttactatttcatttttggggaataatagtaaatgctatttttttcttttttctttttgtgtttttaattctaaatttttaaaaagaaattttaagaatatctaaaatttcaaacgccaagttccttctagcaataatgggaaaaattaacgtttattttgaaggttttttttcttatctgacaagtgatgttgaatctcacttacacaattaaaaagaaacaatacacaataactattacaacaaaatgaacagactttggtactggtttgaagagattaagagcttaaatggtcttaaagagattatattgctcatttgccagaatccatgctttcaaagaaggctgaccacaggcagcctttggaaattaattattaagtgtatattattatatataaaaccttttcatgctgcaaacactacaatatatttctgcaatatcaactaagaattttattctttttctatgcttacattttagaaaataacagtgttttaagtcaacaacatacatggatggtaatatttatgctaaatatggcataacaaccaaataactccttttatttagattcccatatactataaaaacttacaatgcatctacaatttaataaagtatgtgttatcaaacaatactataaaatgaataattgtagtagaaaccaaggttttacccccctctttttgagaattatgctttacatcagtcctccttccattagtctgttagttaaaaagcatattgtcactgcaaaattaattgtaatgtttcctatgcagacatagtgcttaatagagcccactgtctcaatagaaaaggaatctgtctagtttcagccaaatttatttagagtcagataaatttgattaaacataaaacaagtatccatattgaacacctcagttacctaatcctttacagtctagtccattattaacagtattaagatcataagggattaataaagtttctacagaagggaacattttcccttgtctgatttcagtaaaggagcatatagctttgataaaatgaaatcatcatcatcattttctaaaatattctttatgttttatgtttcttgggcttactgtgctgattaagtggagtgataacatattgcactggtaccttatcactccacttaatcaatacagtaatagagctattagtttgaatcctaaaaacttatcattttttggtcaaaatggaccaatatcagcaaattcatatgattcaatctatgtatctatcttaggtatatatggagtggcgtatgaataaacagatatatatatgatttgatgagttaagaataattgggtccagagaaataaagttctctaggcaccactgttctactgaaacaattaatttgttttgatctttatatacatgttcgattagatgatttaaaattttaaagtattaaaagtttaaaaactagttttaaaagtttttttaaaatgatgtttacacatttaattactcagtgtattttttttttttttcgagacagagtcttgctctgtcacccagggtgaagtgcagtgacaccatttccgctcactgcaacccccacctcccaggttcgagtgattctccagcctcagccaccctaaagtgtgccaccatgcccagcaaaattttttttttgtttgtttgtatttcttagtagagacagggtttcaccatgttggccaagctggtctcgaactcctgacctcaaatgatccacctgcctcagcctcccaaagtgctggggttacaggcatgagtcaccttgcctggcctacttcctcagtcttactgagtattttcccctgagaattagataattggccttaccacattccaaaatccagtgattctcttcttaacatgctcatgttatatcccacacaacagtactaatacattattctaattttgcttgcaatgttgctatagtatgaatatttgtgttcctccaaaatttaaatgttgaaagctaatccccaagaggttggtattagggggtgaggtctttaggttgtgattaggttatgagtacagagccttcttgtttgggattagtacccttataaaagagaccctagagagccagctcgcctcttcatcatataaggacacagcaacaaggtaccatctagtagctaggaaacggtctgtcatcaggcacagagtgtgccttcatcttgatcttggacttcccagcctccagaactttgagcaatgaatctctgttgtttctacgccacccagtttattatttttttagtttacgccacccagtttattatttatttttttttatagaagcccaaatggatgaagaatgatagttatttcatagtgaagaatataaaaataatcagcatcactacatccataatcagagaagggaggggtgggataatgaacagagtcataagtataatgtatttagaaatctgggatgaaatcccataaactgaattgagttgagtgccctcctcccccatgatgagtgtgtatgaaaatgcactagagagacagaaatgaaaaatcagggccatcctcaccatgctctgaactcctatgagattcacttgtcatctttcttttaaagatcttatcgtgtattatctgatattacagttacccattatgaggaattatcataagcataacctttatcatcattatcacctttactatcatcgtcatagacagatgtaaatctagcagaatgcaaatataagaaaatgggacctgactcacgtaagaagactttgaaagtttttcttctatcaaaatctgacaagttggcttaaaagggaagatgtgttcataacagtttctttcattttttccatttccatggctaattacattgtaatactccattaaggtaaggatatagcattgtttgtggtgaaatagactctccatgagcaataatttagattgaaaaaggtaaaatatatatatttccacagtttactttatgcaaatggagtgagttgtaatttttggtgagtgggtgagaggtcagttagatgactgtatggaatttaaaaatatccaattacatatatggcagcatcagaagtctctttagcaactctcacaatattgtatagagataaaagcagtcagacagggcaataatcagagccatattactcatttataaaatctcaatgaaaattttctctgaattaagcgttaacaaagaaggatgaggctcaattgtgatggtacgacagacaccaaatgccaatggtacaatacgtttagtacaattgccatacttctatgtgatgttttgtttttatcatgatgttggagcaatagccacagggacagaagtaagcgggttagagggtaaaagttgaatgaatatgtacaggtataccttggagatactgcaggttcagttccagatcaccaaaataaagtgagtcacatgaattattcggtttcccagtgtatataaaagttatatttacattattttgtagcctaagtgtgcaaagcattatgttaaaaaatgtacataccttaacaaaaacataatttattgctaaaaaagctagcaatcatctgagcctttagtgagttgtaatctttttgctagtggaggctcttgcctcaatgtggatggctgctgattgatcagggtggggttgctgaaggtgggagtgactgtgacaactttgtaaaataagacaacaatgaattttgctgcatcaattgactctttctttcacaaaacatttctttgtagcatgtgctgctgtttgatagcactttactcacagtagaacttctttcaaaattggagtcagtcttctcaaattctgccactactttatcagctaagtatgtgtaatattctaaatcctttgttgtcatctcaacaatgttctcagcatcttcaccagaagtaaattttatctcaagaaagcactttctttgctcatccatcagatgcaattcctcatccattcacgctttattatgagattttaggaattcagcaacatcttcaggctccacttctcattttaattctcttgctattgtcaccatatctccagtgacttcttccagtgacaacttgagctccttaaagtcatccatgagggttgaaatcagcttcttctaaactcctgttaaatgtgatattttgacctcctccgatgaatcatgaatgttattaatggcatctagaatggtgaattccttacagaaggctttcaatttcctttgctcatatccatcagaagatttattatttacagcagctataaccttactaaatgtatttcttaaataatgagacataaatgttgaacttactctttgacccatgggctacagaatggatgttatattagcaggtatgaaaacaacatgagtctccttgtacatctccaaatgagctcttggatgaccagctacattattaatgagcagtaatatttttgaaaaaaaaaatatatttttctgagcacaaggtctcaaccccgggcttaaaatattcagtaaatcatgctgtaaacagatgtgctctcatccaggctttattgttacttttatagagcaaaggctaagtctatttagcataattcttaagggccctaggattttcagaatggtaaatgagcattgcttcaacttaaagtcaccagctgcattagactctagcaaaagaatcaccctgtcctttgaagctttgaagccaggcattgacttctcctttctagctatgaaaatcctagatggcatcttcttcaaatagaaggctatttcatctacataaaaaatctgtcatttagtataaccacttttatcaatgatcttagctagaacttctggataacttgctgcagcttctccaactgcacttgctgcctcaccttgcacttttatgtttggaggtggcttctttccttaaacttcataaaccaacttctgctagcttccaacttttcttctgcagcttccttacctctcagccttcgtagaattgaagagagttgggatcttcctctggattagctcttggttaagggaatattgtggctggtttgatctgtctagaccatttaaattttatccatatcagcagtaagactgctttgctttcttttcattcatgtgtgcatgggggtaacacttttaatttccttcaataatttttcctttgcattcacaccttgactaactgtctggtgcaagacgcctagatttcagcctaactcagcttttgacatgccctcctcactaaacataatcatctctagcttttcatttaagatgagacatgtgagactcttcctttcacttgaacacttagagaccactgtggggttgttaactggcttcatttcaatattggtttgtctcagaatagaaaggtccaaggagagggagacagatgtgggggggtgggggtggccggttggtagagcactcagaacacacacaacattgattaagtttgttatttcatatgggcatgactcatgttgcccccaaaaatgacaatagtaacttcaaagatcattgatcatagatcatagatctccatatattctttcagtgtggcttttgtactctaaccagtgtcagcttgttgagggcagaaatcatttctgattaatctttctatgctttcagtgttactaagtgaatgatatttgaactgcaaaaatgtgatgaaatgtgaagatatgacagtgagtcaagaaagaagatacctctgggctttattcatgaaacagcagagatataaatagctttaacatataaattggttgaaagtaagttaaagcaaaatccctatgctaaagagttataatactgtctattgtgatgtaaatatgatagttgaattcataagaaatttttcaatggcaaaatgaggcttggtgatgagattatcatctctaagaaaattcagtcttaagtattactttatgtcgtttttattctccctgaaagtggcctcaaacattctatcttcatcaacattatccttaccacagtgctacttacacattttcccaatttatcaccagctgtcatgcaaaacccagaacaaagccacttagccaaagcacatgtttgactatgaattagacttcttctttttaaaacaaaggtattatttaaacctattgatgctggcttccatcttaagcccataactggcaaccaacaggttagaaaataaaatttcctaattaattgattaggaaattaaccaatttttgttacatctaatactggttggatgtattgttacatccaatactgtttgtgaaaacttgtgctgttggacttgttgtgcttgttgtactcagtcttgcttaatttgtgaaagcatcacacatttaaagtagcccattagctgctttctagctgaggatgagtaggtaaagacaattatttctacatttgtagttggaagtagtcgtagatattatctaattcagtggctttcttcaagatctcagttttctacagctgtgtctatggggttatagggtgaaagttggaataaatggcagttgaatcaaatcgtcctcttgttttcattcaagatgtctacaccttcaattcttcttttctttgctgggctttcatatgagatttttaaaaaaatgtgtcctgtgtatttttaaaatgaaacttgatctattacagtatattctacagttggcaaatatatgaaatattttctatccttcccactgcattcatgccgagcacatacggcatcaaataatggtattttatcccacgagttccaagtagatacagtctcagtctgttatagtactcctggaaactactatcaagcaattgcacatggtgtgatcaacatttgttatcttttctatcactttctatcttctttattctttaatgatttgtaatcgaatgcttccattttttcagaagagaataaaaggcccagaatggtaatgactgttaccaagtcacgatgtagcaaaattggtgtgtcacttctgacagtttctctaactcccaaaccaatgcatattttgataattgccctcattatttcctcaaatatacttccctgtcagaaaaaaatgattatatataaaattaaatgaggaaaactattaataataaaatatcatgttgtcttgggttgccttttaccagaagtagaccctgagcaaattatttgagtgccagcaacttatttcggaggtgatcccaggaagcacagcaaagaagtgagtgagacggagaaaagaacaccagtacagtgtgagtttcatgagcatgtcatcagtgataaaatgaggttcagtaccacttgagaccactaggagaatgatttgtctcacctgagaagcaagaaaggtagggtagttcccacaaactcccatgtgtaatgtgttaagaacaataatcattataattaaataatggattattaactatcacaacattgtagttctattagtctgagccttaatgcatacagatttttgcaaacttcatggaagtttccattttatttgaaattagtttttgattaaaaataatggaacgctccttcaatcaattaaaaatatcagcagatccatctgcttggaaaatgattcttcctgatgctggcttccatcctactggttgacatcattacgttgggttaagcagtgacatgggtaattgttcttaaaatgtgatcaattctcttattctcccacacacttttgacctgcatttattctctatctttgttatattaaagattgtcaatgttttcccttaatttgacagcacaaatgaatatcaacatggcactattgcctcaaaatggaaaaggcaaaaaagcaatcatgaatcacatgtttctttaatatacagttacagattttgagttcatttccacttctgattgtggttatatcttccaccttccctttcctttcatgccgttttatattaaaggtcaatatgttcatttattaattatgcaacaagtgtcatgtttacaatgtttgtaaatgtagtcacagtatttgattttcttaatataataaaatttatcctctgctttggctaatataagcccacaaatgatcatttcattttctaataaattaaaagtataatgtatacaattggattctgtcaggcttgatgtgtcttttaaacacagcacattaaattccactatgtataaaaaggactgtatataatgtcaatagagaataaacagaattgctacaaaaagcatcgacataaatgattaaatatacatagctcttggcatgtggcttcctgttacacagaattgtgctttttaataatggataatttcaaaaccaatttgctggatacttaatgcatctttgagattttccttccacagagaagatttaggagattataaagtaattaatttgttcacttctttattaattttctaatatcacaaagctatgcattagaaggaagtaggtattaacatctcatatcatttgatacatccactgaattcctacgctctttgcagcctcaaggcacctgtgtgctggcagactttgcagagtactactgaagttgaggctgtaaaccaatcacgcatttgctctgctttcatattgctggcattatacatctgctattcgccaaccccaaatccttcagtatgtagttctcattttctgatgaaaattcagtggaaaaaatggaagtagatatttgcttttaatttcaggtatactttacaataaccatgctgcacagtacaattgggtgattggtgaactccatcattttctattagtgatgaaacaagacaaatgaagaaccacatttttgctttgtgttactttaccaatatgcctgaatccatgtaccttataaacgaaactgtcaatttactcttctattattttaggtgatgattccattaaattaagacctctggggaggtcatgtgtaagtcacaaaggaaatagagcctttaaaataccatgtagggtaactatcataccatcataactaaatatcccgacttttacggtgtgaaatagacaaaaatggtaacttgggtcaacgcatttccctaaactgaatgaggaggaatcttgacaatagtactgctcgtgtactatggttagtaatattagagggaagaaggatgcaatggaaatgatgtcaccttaggactcaaacaaatgtcttactggctgtgtaactcattactactttaagttaaacttgagtagctccctccagaagagctaagcaaagggtaaaaaaaaaaaaagaatagagaattcatggccctcaggcactaatagtttatgaataaatcaataacctgaaaagtacatcacagcaaaataagtggtgaaacaagtattaggaagattctatgcacaggggtgcatgattcagccaaaagtaaagaagaggcactagctacactattttggaggattataaagcatgtaccaagtaaatatatgtgaataagaattgtttatgactgtgggatggagtcaacatttccaaaggcacatgaaaaggaagtgtgttacagtcagagaactgtttgtatggctagggtgaggcattcacatggtggatataagattagactgagcacatggcagggaaattgttgtaaagtaccttctcttcatgcaagttatttgaattataatctataaataatataaagccacctgtggactttaagcagtggaataacttattaagttttgtctttgagagagataagcctagcagccttgtgaagggtaaactggagagaagcaagaaggaaggtacattaggaagctatcagtgtattcgaagtcagatatggggatctaaactaaggtggtgactgtcaggagatatggaggggggatggcagagctaaaagaaatttaggatacaaataggagaaattagttacatggctctctataaagaggaaataagacttcctaccttgcttacctcatatggttcctatgtgaataaattaaacttgaaagtattttgttaattttaaagctttatacatttaaggaattaagattatcaagtacttatgaattaaatgtacttgttttattgacattcctatttgttcacatacagtgaaacaactataaacatttgcttcacttactccttaagaggaaagtagcatgctaggtaactcatctggatttaaatttctaagtggaagtactattgagtatctactctgcatgaagctagggaagtgtggcaaggggactctagccaaggactagaagatagagagactgagagcaagttgtttctcaggcatctgtggaatgcttctccaatgaacaagaaagagaaagaaatatttggaactaaaatatgcatgagaagtaatcaaccttggaataggttgctaaaaagaattaaaagattcttataataagttcagtctctaaatgcaagaaaagtttagtaataatctggtctctggatattaactcacctaatccgtatttaggttgcacatgaataagagttccgtatttagaaaattgtatttattcaatacaatgaataaaatcaaggccaacgaagtgacttctctaattaccgttttggaaaaaaaagatacagaaaatgaattatttaatgatattggaaaaagaggttatccctaagacctatgtatggcagaagaactaaaggcaggtagtgacccaaatctgtatcactaactcaatttccttccaagcaggtacagaagtagatcatggaaggagtgaaatgcatagaatcttataaagatctggttctgattagagctgtttcacaagtagcttaatctcacttaggctcagcttctagatctataaactaggcataataaaacattttggcgggggttgttccaaagattagctaaaataacgcatgaactgcacctagcatgttaaaaataaatagtaaatattaatgtactagtaattatgttttgtaaactaaattttatctcactaaaagaaagtattgtaaaatttatgttgttcttcatccactatagaaaatgaaaactttttgaattagaaccaaatttggaatgggaacatccaagtaataagaataaatgtgaaaagaaactgaatataataataaagttatgaaagaggaaaaataaaatctgatgccgaaaagaacatataggttttttttgttttgttttgttttcctttgttttttgagacagaatctcactctgtcacccaggttggagtgcactggcacgatcttgactcattgcaacctcagcctcctgggttcaagcgattcttctgcctcagcctcccgagtagctgggactacaggcacgtgagcccacctaatttttgtgtttttagtagagatggggtttcaccatattggccaggctggtctcgaactcctgacctcatgatacacccacctcgacctcccaaaatgctgggattacaggcatgagccaccacgcccggcccatacaggtttaaatattgcatggccatgctatacaacagtttgttagctgaagatatttttgttcacaaaatcaatgagattaatcacgcatcactctatacttgctattaaaattactatgtcacgcattttgtggccttccaaaagagacaaggagtttgagtcacagtattagacaagactaaagaccctacatggtttactagaaaaaaaccctttacttcagtgtcaggagacttttattacgtatctggccttactactaactggaagaaacttaaaagaaatgacaatttctctataagtcacactttcctcatctttcaaactaagatatgggactaaatattctttaatggtctccgggttttgaaattctaagttcctataaaagatatctgtctagatgtttgcaacacatacaataaatgtagggaccatataaaaatgtaaagatctcatacctataaaaaccaaaattgtaaatcaatagaaaaatgagcatgagattagaaaagtgcacttttatatatttgtgttatagttcagtaaaacattttaaaaatcaagttgatagaattactttctttaatctacaaagggaaattactaatgaaagttgggaggaaatgttatccttactatagataacatccacatgagcaataaacacaaaaaatggttctcaaattaattagtcactagaaaaaaatggaaatgagaaacacaatgagatactatagtataacagccagaaaggctgaaattaaagactaataatgctaagcattgacatgtccagaacttctataaagtaatgatggttctttgtttacctaccttgaaaaactacgtggcattttcaactaaagatgagtatttcactattctatgacctaataattctacttcttggcacataacagaactacatgcatatgtgcagtaaatttgcaagaatattcaaagtggaattatttttaagagttcacaaatggaatcaatttaaatgttcatccagagtagatggaataagtaaattataggacatttatatgatggcatactacacaacactgaaaattatgggaccacaactacaagaaacaaattagatagatctcacaaacagaatgttgagatttaggagccagaaacaaaagagtacagctgtatggcttcaagtacatacatttcaggaactgtctgtcctaatcaatggtgtgttagatgtcagtattccacttacctctgggagagtattgactaggaagtggtaagacaaagtttttggatgctggtaatattcttttcttgccttgagtaattactggggtgtgcccaatctgtgaaaattcatgaagctggacacctattgatttgtgaacttttatatattcgtgttatagttcagtaaaatgttttaaaaatcaaggaggacagaaatactttccttaatctataaagggaaattactaatgaatgttgggaggaatttttctttgcctttagcctatatatctaagttacttcagcgagtcagagatataaatagatatatagataaatatatacatatatgtgtatatatgcatatctatatatgtcagaagaagggagagagaaagaggagagagagagacttttttcgataattaaattctttagaaaatgtactgcttgagagagaatgactttctggatgattcgattcttcagaaaatatcttgtttacctgtctctttttaatttcctaggaggagttgggtgtgaggctggagatcaattaaattggaagatgttgaaattggataaaaccttacggattatctaacacaatttcttattgttacaggtttatttggcaatagatctattctatctgagatgttatcctttcagccctcctttgtaacctctgaggtctgattctgtgattaatttaactttatacatgagtgaaacattttcaggtagcttctaattaaagagtgttagacattgagataaaatatgacaaggtctctaaagatagcataggaaaaagtttccagggatagacgtacataaactaccaatgggaggtaactgttttcaaatcctcctgaaagtttgcatggtcatgctcatgctagctttaatcatatttaatatcattgtatgcaactggcttttagaccagcctagacattttccttctaggtttgattccagtgaagatgagcaacaggtggaaggcatgctcctttttatttcaagtgacacttcaaatatgtcgctttaccctttactttgaattactatttttcactggatttgctttctttctgttcagttatcattttgctctttgatggacttgccagtttttccacatcactcacactaggaactccggaaacctctagctcagtcctaagtcagctttactgtctgggttcacagttgctgttgctctctgcttagctattcactgtaaatatttttctcttctcatccacataaaccacgttcgtctctaaattcctcagggactgtatcttagtcatcttgctctagcacagagcctggcagttagaatttatcaataaatatttgttggatgaatgaaaagcagcagaaacaacctttcatttcagttggtgggctctaatcctgtctggatgacctaatggagaaatagactctgtttcctgccactgtggccaccaaaaccagcccatgaatgggtcagcagccaaagggagaggaacctgagattcctactcactaatgtgtccatcacatgcaggcttttacttaatctcctttttacacttgtcatagaacataaatgagtcccacatctcccctaaaacccatacaatttcaggttagcattagtgtcactttcaataatccagcttattgttgctggaccgaacaattctacttatagcatgtataaaagaaatctgtactagtaaaaacagactatgatggtccttatcacattttatcctgggagtgttataatcagttgtaacaatgtcatgaccagagctgaatgatgctgataagtttattttcccttagctctttgtattcataaccctgtcttcaaattgcaacataatgtcaatatttcttctggaaatttgataagcaccatccatttaccttcaggtgtacattgacagcaattaatctctgcgtaccacctacgtttccagttgtcatcctgtacctcctctataaacgtttgctcaaaagaacatctcagttttacttttgtctagacaatatttttacccatttgcttatttactgcagtgcactttaggctgtaaccccaaagctcaagaaaataagttttttggaagccagtcatgttaggcatataatttatatgtttataatttaagtcatcttttcaaaagtagtatatatattgaatatttaaagtattcttgttttattcagatgtcacattttatattgcaattagtatctataggtcaaaatgtatggagttataaaaaaggttttctttaaaaaatttgctttccaacactatcaaaggagacactgaaacattacagctaacttgagttttttcatttaatttaaagatagtgtgaacaggtactgaagacactgtcttacattttactaatatctatatagagtggattaaatttgtgaaaacatatatctgcacagagtctataaatttctcaaggtcagaaaataaaccataaaaagatttaattcctctaaagctttaagcatgctaacatttgttaacttgatcttataaaatgacatttgagatgtgtttatcttccaacctaaaatattaatttttattgatcaggttataagtttttgcttacttgcaataactttattattttttctgttgaccctaacatataacaaatgaagacatgtgcagatataacatgttaagaagataaataaaacatcaacactcatgttaacactgcaaatacacatgagagctttatactaagacggccatctcctccctctgacttatattttcctgaaggacatttacatagcataaatattttaaagacttttggctatttgatgacaccttgaacatatactttgaatctaagggaaaggagagtcatatttatctcctttctaaaacaattcaaatgtgatgtgtccctatttgctaagctgaaagtaagatgaagtcaaataaatggaaaatcaaatatttttaaacttctaggagctttttgtttgcttttttgttattttaataagagaaacaaagtaaaacatgtaaaaacacaaactctcacccagcatcctcttacgaaatacccaattttcaaataagcagtactatttgctctatttattactggtctttaagagaaatagacctaaaaaagaacatcttggaaggctagtgtactttcataattccctgagaagctcagtgattatgagtaatgtgaaccagagttcaatattcttacccttggaatcaggaaaaagaaagtcctttaaaagatcaagatctttgatagcagtaacaagaactaaatttgccaggggtagagccgtcctcttaccaatttcaggcaagaagcaatcttttcttgagtagcgaaaggcaagccaactaaagaaaaaatctgtgtgacttcaattacataaaattgactagatggttaaaaaacaatactttcacagaattttttctttctgtaaaactttacttgtatgttggttcttatttcattcagagatatattaagagcaaatgaaattgtgaaattattttcaaatacacaaaaaaagctcccccacgacaactttttctcaattgcctcttttgcctttcctcagttttatagtcttcagtgggtctccctcattgctccatattcctaagccaacaggaagaatttctttcagacccttaagccttgtgtctgttaccatagagacaggcatcacaaagtagctgctcaggaacatcctcatggaaatacaataagaatcctatgggttttacaggaatttccagcgctaccagtgagcagaaattatatctttccctagaaaaaaaatgtggggattttagttgcacattatggaactatggagattgtaatatttggtggtaaattcagaatccctcagctttatgcttagaatttgattatagtttctcctatgacatgaaaaaaaatcccttctcatatccctatgttcaggaaaatataaataactcattgctaattcttaaatttagcatgtcttatcaatcatttactaaaacccttaactgttcttttatagtgcagtgcatttgttttatcttgatcccttctagaacatatttgatcaagaacacactcataatgttataaaagtaagtctctaaaactgcaattccaaagctgctgagagagtctataaacccacgaagagagaagagggtagctgcaagaagaaaattccactcactttaccttgttttccattgactttcaccctttctgtaagtctactgaaatcatacactaacggaaaagcagcaataaaaataacagaatcctaccaaataggtaaattcagcaagattaatggagtcaaactaggcagatattatatataagtcaatgattgcagagacttcaattttttatggaaacattaaataaacattcctcaacaagtaaattatctcaatagactaacagccaaatgaaaccatctttatctgttaggctgcatatttgaactacttttccaagtctctagtacttaagtagtatgggtggttacaatttctgtttatggtatagaactgttatttaactgttacattgcttgtttagatacttgagtcaataagcaaaaaacaaaatttctttatagtctagagatgaggtgagcaaacttttcctatcgagggccagatagtaaatattcctgctttgtggcccacatggtctctgtcataagtactcaactgtgttttagcatgaaaggagtcctatatagcatataaacaaataaatgggtgtggctgtcttccaaataaactatagactcttaaattgaaattttatataatctcatgtgtcagaaatattcttgaaatgaaacaattcagaaacgtgaaaaccattttaaatgactggtcaaacagtaatagatgtgacaatgtggactatcatttactgacccctagcctggatgatgcgagtggagtagtagagaccctcagagaaataaatgtctaaaaaaaagaacatgtttttaaaagaaatgattggactcacagattcttagttaaaaattatctcagacatcttcttcaatttccatttagtgcagaaactccattcttagcactgaacactttaggaataaggagtgcagtgtctcacaaagtaatcaattctctgctcacaacattaactggaagaatacttttccattgctaccaaagaggtgcaagtgagtctaaaccctcttctgcattatagcacatcgaatatttgaaatcagcttaattttctctacttttttccttcaagtattcttcaacttttcacttttctagtactttccatgcccctcaaatgttatagtttgtaggaccttttagcattcagacacttttcactgaacatacccccaaatgttaaggttcctcttagatcatggtgtccttctaaaatatgtatatattaccacatataatatatacatataccatacctatcatatatatacacacacacaccattatatcatatatatccttctaaaattcgttctcatttttttcatttcctttttcaggatacatgtctaacaatattactttgtttcattgtattttgatgtcatatgaattatgactgataataatgatgaccaacaaaatcagtaagatttattcaattaattattactaagctttaactctctcatgtcctgtacttgccagattgattttatgaaccttagcttaggatgttatacttattcctattacaattattctctttgacctcaccacagtttttaggtggtcataatcctttggtaccctaatagttcaatgtatttgttctgcttcccagatagacaggctatctggatcgtccttcagtttttggacattaatatttcacaggccaagtaggttcaagaacagagacataaggcacattacagaagattaggttcaagtcagatggaaccaattttatagaactatgctatagtcctgtgaaaggccctcttcctggtttactgtgattcattaattgatacatcacaggcagggtcatttagccagctgatttattgaccagactcttatgtcaaacagcaaatatttctccattttcaccatatgggcatcataaaaatctttaccaaagtccatgctataatcaagataactagccatattacatacttttcagataacattggagaatcacagcatatattatctttgcactctttctaaaccatctcaccttcttcaggaattgtcagttactcccagtgaagaaaaaatattgcatatttttctggaaaaatatttccagttttaagtaattatttactctccacaatctaattatggactttccttcctatttttcactttagtttattaactccaggaccaactaaaatattgtcgtggctttctctttttaaacagttctgacttttttttttttccaaagcgtgtgtgtgtgtgtgtgtgtgtgtatgcacatgcttaagtggtttgtttttatttgctttttccttcttaaaagatggattatatgagaatgggaggataataggatggagcaagcttctcaggcaaaacatttcaaagcatatttcttaaccgatagtgtcttcccctgctcatctttctgaagagcaacacctgagaggcagctactctagctcatgtgggaaatttcacttgacagtcttatcacaaaaagagaaataagggagatttttttacttaaaaaataatgatgctcaataaaatttttacctaaaagagataaataattgttttagaatataaatgccttagagaaaacaatctgagtttgagagaattggggaaaactcacatagatttataaaagtcactaattctggatttaaaaatatattaaaatgtttgcagtctatttcattgtgtcccacttctctttcacaccttctatttttatgcatttctccttcatcgttttttcttccttaaagcacttcagaagacacaggattaagcaattgggatttgaagacttcacgtggtctcatcactctgcaggctgaccctgttttagagcaagaaatattggcagacatttccagctcttacaatgcatttatcaataagggtttgcctgctcttcaggtgcgtggcatatagactttacgatttcattaataatcaacagctggtgccacctagcgtctgtccaatccattcatcagtgggaccaaatacagagcactttctaaccgcaaatgaagcaagcctaaactataaactaaaaaatacaaaaacacagtttggggattccagtggctgatttaaagtacgctatcttcattgaaaaagaaaaaccttcttttaaaagtaactatggtaacaagagagtgaggctagaaggaagctcacattttttcgaaggagacaattcacaaaaggagagtcctactaaagatgcagtgtaaaagagtttttacagtcttgaatggtcacttaaaacggttataaaaagttgaaaagtaacattggccaaagagggctgtattttaaacaacagtatagacagagctgaattttctcaaccaaccacaaaataaccctgtagcatttggatgcaaaattctgtcagtctttgagcttcccaaagattaaccaagttctgtaacacactatacaaaagcatctacagtacttaaaagtattaaacggaaataatcagagtgcctgaaccacattataaaaaaaaattctttgctgctaaaatgatacatctagaaaactattttctttcctgctgtatatatgaattatgaatgatattcaaccacggtaatgtatgcttcaaggttaaaaagtagtcatccaaatccttgactatttttcaaaacagaagttagcaattattttggagaaatcctagtgtaattagcccaccacttgctaattaatttactgatatttaaatacatgttgtttttaactcaccctttctaagaggaatacgtaattgaaaaccatggactaacattcagaaaaaaagttacataacagccaatagtgttccttaaccagactgactgggatattacaattactacagaaaaggcacagcacatacgagtagcactgtgtacactgaaaggtcatattagatgtacatatatgatagtctattaacttggatgatttagctcctcaggctatggaggagactgggtagagagccgaaagattctgtattacatagacagttaataatcaggcttttcacacttaggaaaatctatttctatattatttaacatctgttttaaacaatcacttgttaaatgtttgaatgttttatttgcttgttaccctagtggtgataaagattatttcaatatgttcagtctgattacagtcactgacagatccccatgacagcatgtgaagataggttatagaaacgatgcatagtttatacaaaaagcataaattgctcccctttctccaaaaactttatttttggagccaaatactgtccatgctcatgctccatttgcttaaaagtacttataattataatccactgattgtaggggaaagaaatattgcaaaacagagaaagggttctaaaaatcgtacgcaggcaagaaagaatgtaagacaaaactcattaaagggcaaaataaataaataaataaataaataaataaataaatgctcacattttcaataatttatcacttctgtcatttttcattaacagccttcaaagccctatctgaaacaagctgatacagagaaattaagagcagtaatcaagcgagaaatcatagaccagctgggtcgacatcaacttggcaaaacgtgaatacagttcaatagctgaaacagatgctagagttgttgaaaaaccctgcaggagatattgatatattttcttcatataatgcagaatgactgaataaatgtcaaaagctagaaattgatgaggagaaatgactgacagccaaactccttataaaatagaaaccaagtataacaattttcaacctatccaaacattctgtacattctcatttctctcactgtctgaatatgccaatacatcaatcagttcttgcaactaaattgcatataactaatctggggtagatttccccgaagatttttttccccctgtcatcatctacctgaagaaacctagactcctgaacaatactttattctaaaatcttctaacactgatttctatcccagaagtgttttcctgaggttggaggcaagcacaccccctccccaaaatctaacgcagcacaaggcaattttaaaatccattctgtaaaagcaacactgtttgcagagtttgaagagctcggcaacaaaccccagctaccaacagctgcttgttcaaacatatgctttgtcatggccagcttctaattgtatttgtaatgatgtaatagctttaataatcctaccttccatgccagctgtttttcctgtcactccatcatgccaataagttggctgctgtaacaaatcaagatagtgcaaaacagcatctttctcctgattctgtcatcttcctgaaagcattctattactgccgactgctgggaaccagaaagtctatttgaattccaacagctcccctttcgcatgattcaagttaggttaggtgggcatgcctaacatgattctttcagtcatttattatgcagctgctacaacgtcggtgtggtaaccactctgactatctgatacgtcagtcgaacaaaacctatacctcggagcaaacacatgagccagagcagcgtttgcatttaacg
